United States Patent 8,394,390 (NEISSERIAL ANTIGENIC PEPTIDES) - sequence listing, part 4

SEQ ID NO: 38833 - DNA, 2242716 bp, Neisseria meningitidis
taaaccttatccacatccaaacgcataaccgtaacccattcaccgttatggaaatgtcgcccgacaaccacccagccgaatgattcataaaatatttgcacatcaggcgtataaagatacaagaactttatccccagcgaacgcgctgcgcctatgcagtgggcgaccagcctcctgccaatgccttttccgcgatattcaggtaaaacaaagacatcccccaaccaatattcataccgtggaaaactttccatatcatgccgcttgaccgcagccgaacccaacaggattccggaatcatccacagccgcaaatgccagcggcagttcgtcatccttcaaacacctgccgtaataggcatgaatcttatccacagaagaccacggttcaaatccgtgccactcctcaaacaacgcctgaaccaacctgccgatatgcccggctttcagccgtgtaatgaaaacagtattgtccacaaagagggaattcatcggtcaattccccgacgccttcgttccccctgcgccgtaaaccgcattccaagcatggtccaaacgcactccgatttgcctcaaatcttcagcctgccgggctttttgcgccattgctgcaggaatttccgcttccaaacgggcgatgtctgcctgagccgtctgcaaacgccggcgcgcatcttccaaatccgactgcatcccgatgatttttccgtccagattgttttgcttttgcaataaggcgcggtaaccggattggatgctgagcagattgtcttcagcatcccctgcccatacgcttgtagaaaaaacaaccatcagaaaataaaatatttttttcatttttaacttccatttaaatgctgtctgaagccgtattccgacatcagacggcatcgcccacgcctgtggataacttaagcgcggatgcgtttcaacacttcttctttgccgattaatgccaacacagcatcgacgctgggggttttcgccgtaccgcagacggcaaggcgcaggggcatgccgagtttgcccattttaatgccttcttcgtcgcagaagggtttgaagaggtcgtggatggcttcggcattccagtcttccagcccttcgaggcgttcggcaaagcgcagcatacgggcggcggcttcatcgtcccagtgtttctgcacgtctgcttcggcaggcgtttgtttgacgtagaagtagaagcactcgtcggcaagcgtgttcaagtcttgggggcggtctttgaccagttccaacacatcttccaaagcaggtttttcggtttcatgaatatcgcgcaacgcaaggcggggtttgacgagttcggcgagtttgccgttgggtgtgattttgatgtgttcgccgttgatccagtagagttttttcaagtccatacggcttggagacggggaaacgtctttcaaatcaaaccattcgatgaattgttccattgtgaagaattcatcgtcgccgtgcgcccagcccaagcgtgccagatagttgagcatcgcttcgggcaggatgcccattgcgccgaaatcggtaatggcaacggtatcgccgctgcgtttggagatttttttgccttgttcgttaagaatcatcggcaggtggccgtattcgggcaggttcgcgtcgatggcttttaagatgttgatttgtttcggcgtgttgttcacatggtcgtcgccgcggataacgtgggtaacgcccatgtcgtagtcgtctacgacaacgcagaagttgtaggtcggcgtaccgtcggcgcgggcgataatcaggtcatcgagtgcttcgttggggatggagatttcgcctttgaccaagtctgtccatttggtcacaccgtccaaaggcgttttgaaacggacaacgggttgtacgtcggacgggatttcgggcagggttttacctacttccggacgccagcggcggtcgtaagtcgccgagccttctttttcggctttctcacgcatggcttccagctcttctttgctgcaatagcagtagtaggcatggcctttttctaaaagttcggcaatgacctctttgtagcggtcgaaacggcgagtttggtaaacgacgttgtcggcgttgtcgtaattgagaccgacccatttcatgccgtcgaggatgatgttgacggattcggcggtagaacgcgccaagtcggtgtcttcaatacgtaataggaactcgcctttatgatggcgggcaaacgcccatgaaaacaaggcggtgcgcacgccgccgatgtgcaggtagccggtggggctgggggcgaaacgggttttgacggtcatgatggctccgaaatctttgaaagcgtttattttactggttttaccgtgcttgggcatcaaaaatgccgtctgaaccctgcctgcggataaagtttcagacggcattttccttgttttcaatgcttcggcacgcggaacagtgtatcacgcgccgccgaccgaattccttcgggattgcgtccaaaaaaaagttcaatgaaacagctaattgaaaaaatcccgcccccatttttccaaacggtagagggataacgcatatccctcttgcagcataaagatttttttcttatttcccgcatcaaaccgcgtggtcggcgtggcagacatataaacgcggacacccaaatcctccgccatttccgccgcccgcgccaaatggtagggatcgctgacaatcaccacgctggcaataccgttggcacgcaaaaccggacggatgttgttcaggttttcataagtgttgcgcgaagtgttttcaaacaggatgttgcgcgccggaaccccctgtttgagtgcgtaccgccgcccgacctcggcttcggtcatatagccttttttggtccggcctcccgtaaacacgattttgcctaccctgcggctctgataaagtgcgatggcatggttgatgcgttcgcggaaaacaggagaagggcgtttgtcccacgcggcggcgcccaacaccagcgcggcatccgcccggacatacggcggcaaaacctgcccacccgtccgataaaccgcccaaacggatgaggcaaacaccagcaaaagcggaaaaacactcaaacagaaaccgcccaacaggtaatagcgcaagccgttgcggctgcaaaacagccgtttgttcacaataccgcttcgatattttccagcggtctgccgacagccgccttaccgtttgccaaaacaatcggacgctccaacagggcgggatgatcggcgatggcacgcagcagcgcgtcattgtccaaattggggttgtccaaacccaattccttatacaaatcatctttcacgcgcatcatcccgcgcgccgatgccaagcccaatttgttgaaaatatccttcaattcggacaagtcgggcggcgtatccaaatatttgaccacttcggcagcaatgccgcgttcttccaatagggacaaggcggcacgcgatttgctgcaacgcggattgtggaaaattttgatttcaggcatgacatttccttgcttctcgacaatccccttattatcggcttacacagggttttactcaatatcccgcctacaaccgtaccaaacggtttacaatacccgaatcgacatacaaaggacaaaacgatgaaatacttgaatcttgccgcaatcacccttgccgccacatttgccgcacataccgcctcggcagacgaactggccggatggaaagacaacaccccgcaaagcctgcaatcgctcaaagcccccgtacgcatcgtcaacctttgggcgacttggtgcggcccgtgccgaaaagagatgcctgccatgtccaaatggtacaaagcgcagaaaaaaggcagcgtcgatatggtcggcatcgcgctcgacacatccgacaatatcggcaacttcctcaaacaaactcctgtttcctacccgatttggcgttacaccggggcgaacagccgaaactttatgaaaacctacggaaacactgtcggcgtactgccctttaccgtcgtcgaagcaccgaaatgcggatacaggcagaccattaccggggaggtaaacgaaaaaagcctgaccgacgccgtcaaactcgcccattcaaaatgccgttaaacgccggatgccgtctgaagccgcttcagatggcatttttcttttccacccgcctgccggtgcaaacttatccactatctaaaaacaggcggaatctttataatcggcactgtcttacctattgttcagacggcatatccctgcggacgcaaccgcccgaaacgatatgccgcccttccttacaggacctcctatgatccgtttcgaacaagtttccaaaacctatcccggcggttttgaagccctgaaaaacgtcagcttccaaatcaacaaaggcgaaatgatatttatcgcgggacactccggttcgggcaaatccaccatcctcaaactgatttcgggcattaccaagccgagcaggggcaaaatcctgtttaacgggcaggacctcggcacattgtccgacaaccaaatcggctttatgcgccaacacatcggcatcgtgttccaagaccacaaaatcctctacgaccgcaacgtcctgcaaaacgtcatcctgccgcttcggattatcggctatccgccgcgcaaagccgaagagcgtgcccgcatcgccatcgaaaaagtcggcctgaaaggacgagaattggacgatcccgtaaccctctccggcggtgaacaacaacgcctgtgcatcgcccgcgccgtcgttcaccagcccggcctgctgattgccgacgaaccctccgccaacctcgaccgcgcctacgcgctcgatattatggaattgttcaaaaccttccacgaagcgggaactaccgtcatcgttgccgcacatgacgaaaccctgatggcggactacggacaccgcatcctgcgcctctcgaaaggacgactcgcatgagcatcatccactacctctcgctgcacgtcgaatccgcgcgcaccgcgctcaagcagctcctgcgccaacccttcggcacactgcttaccctcatgatgctcgccgtcgcgatgaccctgccgctgtttatgcatctgggcatccaaagcgggcaaagcgtgttgggcaaactcaacgagtcgccgcaaatcacaatctatatggaaacctccgccgcacaaagcgacagcgataccgtccgcagcctgctggcgcgcgacaaacggctcgacaacatccgcttcatcggcaaagaagacggtctggaagaattacagtccaatcttgaccaaaatctgatttccatgcttgacggcaaccccctgccggatgtctttatcgttacccccgacccggcaaccacgcccgcccaaatgcaggcaatctaccgagacattaccaaactgcctatggtcgaatccgcgtctatggataccgaatgggtgcaaacgctgtaccaaatcaacgagttcatccgcaaaattttgtggtttctttccctgacgctggggatggcgttcgtccttgtcgcacacaacaccatccgcctgcaaatcctcagccgcaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgcccattggtcgatgccattttcaaaccctacggacttaatatcggctggcggttcttctacgctggcgaactcgggctggtgttcggcttcgtcatcgcgttgggcgtattcggcgcgtggcttgccaccacccagcacctgctcggcttcaaagccaaaaaataaaacaccgtcaaaaatgccgtccgaacccgttttcagacggcatttcaatttgccagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcagacggcattttttttatatcaaaccgcttacgcgccgcgtttttccaaagcggctacggcaggcagctctttgccttccaagaactcaaggaacgcgccgccgccggtggagatgtagccgatttgttcggtaacgccgaatttggcaatcgccgccagcgtgtcgccgccgcccgcaatcgagaacgctttgctttgggcaatggcttcggcaagggctttcgtaccgcctgcgaattggtcaaactcgaacacgccgaccggcccgttccaaacgaccgtaccggcggctttaagcaaatcggcaagcgcggcagcggatttcggaccgatgtccaaaatcatctcgtcttcggcaacgtcggcaatgtctttcaccacagcttccgcatcggcggcaatgtctttcaccacagcttccgcatcggcggcaaaggctttggcaacgacgacatcggtcggcagcggcacagaaccgccttttgccgccattttcgccataatttttttggattcttccaccaaatcgtgttccgccaaagatttgccgatggctttgccttccgccaacaggaaggtgtttgcgataccgccgccgacgatgagttggtcgactttgtccgccagcgattcgaggatggtcagcttggtggacactttgctgccggcaacgatggcaaccatcgggcgcgcgggctgtttcaaggctttgcccaaagcgtcgagttcgcccgccatcaatacgccggcgcaggcaacgggcgcggcttgggcgacggcttcggtcgaggcttgggcgcggtgggcggttccgaacgcgtcattgacgaacacgtcgcacaaagaagcgtaggctttacccagttccaaatcgtttttcttctcgcctttgttgatgcgcacgttttgcagcatgacgacatcgcccgcgttcagggcgggtttgttttcacgccagtcgttcaatactttcacgtctttgcccaacaggctgcccaagtgcgcggcaacgggggcgacatcgtcttcggggtggaactcgccttcggtcgggcggccgagatgggtcatcacgataacggacgcaccgttgtccacgcagtatttaatggacgcgagcgaggcgcggatacgggtgtcgtcgctgattttgccgtctttgaacggtacgttcatatcggcgcggatgaggacggttttgccctgcacgttttgttcggtcagttttaaaaatgccataatcagtccttttcaatcagtgtttgcgatacggaaacaattgatgccgtctgaaggcttcagacggcatcgcaacccgatcagccggatacgcgctcgattttcgcgccgacgctgccgagttttttttcaatattttcataaccgcgatccaagtggtaaatctgttcgaccacggtttcgcctcgcgccgccaaaccggcgataacgaggctggcggacgcacgcaaatccgtcgccttgacgactgcgccggaaagctgttccacaccctgcacaaatgccgtattgccctcggttgtgatgttcgcccccatccggttcaactcggggacgtgcataaagcggttttcaaaaatcgtttccaccacgcggcagcttccctccgccacggcattcaatgccataaactgcgcctgcatatccgtggggaagccggggtggacgaccgtgcggatgtccaccgccttcggacgctgccgcatatcgatggcgatccaatcgtcgcccgcctcaatcaccgcacctgcctcaaccagtttgtccaacaccacttccatcgttttcggcgcggcattccgcaaaaccaccctgccaccggttatcgccaccgcgcacaggaacgtccccgcctcgatccggtcggggacgacgctgtgttcgcagccttgcagctcgtccaccccttccacaatcattgtggacgtaccgatgccgctgattttcgcgcccattttgaccaggcattccgccaaatcgaccacttcaggctcaatggcgcagttttccaaaaccgtcgtaccttccgccagcgtcgccgccatcagcaggttttccgtgccgccgacggtaacgacatccatcgccacgcgcgtacctttgagtttgcctttggctttgacgtaaccgtgttcgataacaatctcagcacccatcgcttccaagcctttcaaatgctgatcgacggggcgcgaaccgatggcgcagccgcccggcaggctgacttgcgcctcgccgaaacgcgccagcgtcgggcccagcaccaaaatcgaagcgcgcatcgttcggaccaactcgtaaggggcgcaggtattgtttaccgtaccgccgttgatttcaaattcgctgatattgtcggtcaggacgcgcgcgcccatcccctgaagcagcttttgcgtggttttcacatctgccagcatagggacgtttttcaggcgcaacgtacccgatgtcagcaaacccgcgcacatcagcggcaatgccgcgtttttcgcgcccgagaccgttatttccccgttgagcgggccgtttgcggagattttcagtttgtccacgtttgttctttcctggtgggtacttgtatagtgaattaacaaaaatcgggacaaggcggcgaagccgcagacagtacagatagtacagaaccgattcacttggtgcttcagcaccttagagaatcgttctctttgagctaaggcgaggcaataccgtactggtttttgttaatccactataatatttcaattctcgggacaacgcataaagcatcacccgatgaaggttgcagaggcggaattataagggattttcgggaaaaatacggaagccgcaccaaagaatttgacgaaatgccgcgctttccgaacaaggattgtcggaagacaaaaaagccgagttttgaaaactcagcttttttgctttatctggtgggtcgtgagcgattcgaacgctcgaccaacggattaaaagtccgctgctctaccggctgagctaacgacccgataagtttggaattttacagaccggccgaaaccctgtcaagccccttgcgggcggacgggcgttatatccgcttatcggcctgtttttttcgtataaaccaaagaagtcaacaccgatgcacccaatgcgccgaacacgaccgacagcgaaacggaaatcgggatatgcacccaatgcattaccagcattttcacaccgataaaacccaacacgaatgccaatccatatttcaggaagataaagcgttccgccacatccgccagcaggaaatacatcgcccgcaagcccagaattgcgaaaatattggaagtcagcacgataaacggatcggtggtaacggcaaagacggcggggatgctgtccacggcaaacacgacatcgctcaattcaatcatgaccagcaccaaaaacagcggcgtggcgatttttttgccgttttcgacggtaaaaaatttctcgccgtgaaattccgtgccgaccggaacgactttcttgacggtattcagcagcctgctgtttgccaaatcctctttctcatcgccttcgggcttcatcatgtgtataccagtatagagcaggaacgcgccaaacagatacagaatccactcaaactgctgaaccagtgccgcgccgacgaaaatcatgacggtgcgcaataccaatgcgcccaatacgccgtacagcagcacgcggtgctgaaactgtggtgcgactttgaagtagccgaatatcatcaggaacacgaaaatattgtcgactgccaacgatttttccaaaatgtagccggtaaagaattccaatactttttcttttgcgactgccgcgccgtagccgggattgccggcgagttcaaaatacagccagcccgcgaacaggcaggatacggcaacccacaagccgctccatgccaaggcttctttgacgccgactttatggctgccgtttttcttcagcgaaaacatatccaaggcaatcatgaccagcactgccgcaaaaaaaacgccgtaaaacaacggcgacccgatgccgggatattctgtcatggttcaatctcctgatttgaaatgtaattgtgttaccagctgatataaaacatcgcttttgccaaaaagacaatcagcagcatatgggtaaagacgacggcgtgtatgtatttcgaccaaccgaccgtcagtgtggaacgcgccattttgacgacggcgatggcgaagtgcgccaatacgctgaacgccaacaggattttcagcgtcagcatcgtaccgaaggaagtggcaaacggttcgcccaatatagaaagatagcggtttgccgccatcacgatgccgctggcgaacagcagtccgaccacaaacggcatcaccctgacggcgcggtaagacattgccttttccacttcgcgccgcgcctcgcgcgacacccgtcccgtatgcaggacggacaaaaccagcacttcaaaaaacacgccgccgacaaaggcaatagcgcaatacagatgaacgatgtgcgcgacggcataaatactcatacgatgctccaaacggaaaactcggatacggattgtatcactatcgcccccgatatccgcataccgcttcccgcaccgcctcggcgattctcgcgcccgctccgcgatgttgtgcgataaagccgtccacgcgcgcctgcatctgcatcccccccccctcggacgataaggttttttcaacggcttcccgccacgcatccgccgattcgacttgaaccgccgcacccgatgccaaggcgtgtcggcaggcttcggaaaaattgtaggttgaaaagccgaatatcgtcggaacgccgcaggaaagcggttcgatgatgttctgacaacccgaatcgaccagactgccgccgacaaaagcgacatcggcgcacaggtaatacgcatacagctcgcccatactgtcgcctatccacacctgcgtatcaggttcgaccggcaaaccgtcgctgcgccgctgaaccttaaacccgaagcgttttgccgtttcaaataccgtctgaaaatgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtaggttgtcgaagcggtatctccgcccttgcccgtccagttggtatggaaaaactcaccgcgcggtttgtcggtgcgctcgtaagtgtgcgcgccgaagtagtcgcgctgtgcctgcaagaggttggcaggcagacgttcggtcgtgtagccgtccaagaacgtaatcgccgaagccatgcagggcatagggatgccgcattcgaccgccttggcaaccaccttgcgccacgccggcaggcagttttccaaaatatttttgaaatacggatccgcacccaagaacaccaaatcgggattgttttcatacgcgtcgcggatattgcttaagaatgcgctgcgaatgatgcacccctcgcgccacagcagcgcagtgttgccgtagtccaaatcccagccgtagctttcgcccgcttcgcggatcagcataaagccttgtgcgtaggaaatgattttagatgcaagcagggcctgtctcaacgcctcgacccattcttgtttgccgccttcgacgggcgtaacggttcgggcgaacagtttgccggtctgcacgcgctgttctttgaacgacgaaacgcagcgggcgaatacggcttcggaaatcagcgtcagcggaatacccaaatccaaagcattgatgcccgtccatttgcctgtacctttttgccctgccgtatcgaggattttctcgaccagcggttcgccgccttcgtccttatagcccaaaattgccgctgtgatttcaatcagataagaatccagctcggttttgttccactcggcaaacacgcggtacatttcgtcgtaagacagccccaagccgtctttcatgaactggtacgcttcgcaaatcaactgcatatcgccatattcgatgccgttatgcaccattttgacaaaatgccccgcaccgtctttgccgacccagtcgcaacacggttcgccctgcgacgttttggcggcaatcgcctgaaaaatcggcttgaccgcatcccaagcgcgcttatccccgcccggcataatggacggcccgcgccgcgccccttcttccccgccggacacgcccgcgccgacaaacaaaatccctttttcagcaaggtaatgtgtccgccgtgtcgtgtcggggtaattggcattgccgccgtcgataaggatgtcgccttcttccaacagcggaagcagttgttcgataaattcgtcaaccaccgaaccggcacgaaccatcatcataatttttcgcggtttttccagcttatcgaccaaatcttgcaaagaatacgcgccgataatattagttccttttgccgcgccgtttaaaaattcgtccaccttggcagtcgtgcggttgtaggcaaccaccttaaatccgcaatcgttcatattcaaaatcaggttttgccccataaccgccaaaccgattacaccaatatcgccgttcattgcaggaagctccgttatagatttaatttatcgaccgcaactctacccgatttacacttgtttaacaatccttaactttttaattttttgaaaagatgcctttacgctttgctgtaccgttttgctgaagggttataaataaaatataaaatttaaataataaaacgatgattatattgataggagaaattttctgtgggtaacttttttttattttaaaaatcatcaggatttcttttttttagggtgtcggtaaggcggattcccttttgtgcatacctgtggattgtttttcatgaagaatagtttttgtggacagtttgcttgttgtgcaaatggcatcctacttttctttaccgaatggctgccgatgtctttaagaaccggaatactgtggaggtttgagaggaaagtgtgtttggaacttgtggaaatggtcaggtgtcggcacgaatgtcttatttctgcatatcggcagagtgcgcatccgaatttgtgtataagtggtggaaaaaatgagatttgcgggtaaatctcacaatatttcagtcagataactttggattgcttgtgtataagtaaactttcggatggggatacgtaacggaaacctgtaccgcgtcattcccacgaacctacattccgtcattcccacgaaagtgggaatgatgaaattttgagttttaggaatttatcgggagcaacagaaaccgctccgccgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatccagaccttagaacaacagcaatattcaaaggttatctgaaagtccgagattctggattcccactttcgtgggaatgacgggattttaggtttctgattttggttttctgtttttgtgggaatgatgaaattttgagttttaggaatttaccggaaaaaacagaaaccgctccgccgtcattcccgcgcaggcgggaatccagaccttagaataacagcaatattcaaagattatctgaaagtccgggattctagattcccactttcgtgggaatgacggcatcagtctgccgtttacagcacggtttctttagattttacgttctagattcccgcctgcgcgggaatgacgaatccatccatacgaaaacctgcaccacgtcattcccacgaacctacatcccgtcattcccacaaaaacagaaacctcaaatcccgtcattcccgcgcaggcgggaatctagacttgtcggtgcggacgcttatcggataaaacggtttcttgagattccgcgtcctggattcccactttcgcgggaatgacgaattttaggtttctgttttggttttttgtccttgtaggaatgatgaaaatttaagttttaggaatttaccggaaaaaatagaaagcgttatccacaagttctgatgttcagctcgtgaaatgcgtcgggcaaatcatcgctgtcggcaaattccacccggtcgtaagccgtttcgtctgccaaaaccgcgcgcaagagtgcgttgttgatggcgtgtcccgatttgtagccttcaaatgcgccgacaatcggatgtccgacgatatacaaatcaccgatggcatcaaggattttgtggcgcacaaactcatcgggatagcgcaagccttcaggattcaggacatccgtgtcgtcaatcacgatggcgttgttcaaattgccgcccaaacccagattgtgggcgcgcatcatttccacttcgtgcataaagccgaaagtgcgcgcgcgcgcgatttcgtcgatgtaggatttgccggcgaaatcgatttcaaaagtgggcgagctgcggttgaaaaccggatggtcgaattcgatggtcagcgttaccttaaagccgtcatacggcgtaaagcgcacccatttgcccgcttctttgatttcgacaggcttgaggattttcaaaaaacgcttttgcgccttttgatcgaccacgcccgcatcttgcaaaaggtaaataaacggcaggctggagccgtccataatcgggatttcgggcgcgttcagctcaatcagcgcattgtcgatgccgtaggcggacagcgcggacataatgtgttcgatcgtgccgacgcgcacgcctttgtcggtaacgatggtggaggaaaggcgggtatcgttgatcaaataaggggtcagcttgatttgttcgcccatctcgccgtccaaatcggtacggcggaaggaaatcccgctgttttcaggcgcggggtgcagggtcagcgcgacgcgttcgcccgaatgcagcccgacgccggtaacgctgatggatttcgccaaagttctttgcagcataaaccgcttccttatcaagggggtaagttttggaataatacgataaaaccggaaaaacaggctatgtttttccatagtatttgccaatgtatccgttttcaatacgtaagccgcataaaaatgtatagtggattaacaaaaatcaagacaaggcgacgaacccacccccctcctgaaaaacgcaaaaaatgccgtccgaaaacctttcggacggcattttcgcgtaaaccgtcattcccacaaggacaaaaaaccaaaacagaaaaccaaaaacagcaacctaaaattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcggcttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgtaaccggccggttgccgtcattcccgcgcaggcgggaatctagacattcaatgctaaggcaatttatcgggaatgactgaaactcaaaaagctggattcccactttcgtgggaatgacgcggtgcaggtttccgtacggatagcttcgtcattcccgagtaggcgggaatctagtccgcttgttcggtaaatgagagggcggattgcgcgcctgtcagataaaccacgtgtttaaacgggcggcaatgaggtacgcgcagagccttgaagcgcaatcgatatattattttcagccaaaacggacgcccccgcttgccttgcaaacctttaaaaaggaagccacccggattaatccgagtggccgtggaaaatcacttaccgcttgatttatttaaaatttatggtataatttaccttagctggcatcacttgcgtcgcggcaggttgacggcaggtgcttggtgtcaatcttcttaccgttggcggcggcggcggcggtaacgtcgtcgttggcggctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaagtgttgttgccgggccattcgccgtgattcaggtaatactcggtaacggctgatttttgaccttcggccaaaagaatggcttcggaaacttgtgcgcgggctgtgtagtcttgataagcaggaagggcgactgccgccaaaatgccgacgatggcaatcacaatcatcagctcgataagggtaaaacctttttgaagggtgttcataaaattactcctaattggaaaggaaatgcctcaagcttacgccatcggcattatgcaatgtatttgaccatcggtattttgttgcgatacctgtgtattataaagcaagattggtaccaagtttgtattttgaggtgaaaatttatgcgtttatctctatgtaattgtttttattttacattttctttcgtttggcgtggtttgagtaattagggggttgccgttttttgtcagcagtgttgaaaattgtcagttttagtgccgattttcggcacttttttattggcgtggggtatctctattggcatggggcatcgggtgtgttgattgggtcggaatttgagatttttgaatttgcgcggtagcatagggtgggttgggtgggaaattttaaatttaatttttaaaaatttccgttttcttggaaagtgattgaaatcggcgcgtggtgttcctgtgcaaccggcagttgaatcatcgcggcaggtttccgtgcggatggcttcgtcattcccgcgcaggcgggaatccagccttgttggtacggaaacttatcgggaaaacggtttcttgagattttacgttctggattcccactttcgcgggaatgacgcggtgcaggtttccgtatggatagcttcgtcattcccgcgcaggcgggaatccaggtctgtcggcacggaaacttatcgggtaaaaaggtttcttgagatttttcgtcctggattcccactttcgtgggaatgacgggatgtaggttcgtgggaatgacggtttaggtatttttatagaaagccgtaggtggtgtttctatgcaaacgacagatgaatcatcgcggcaggttgacggcaggtgcttggtgtcgattttgtcggtgccggtggcggcggcggtaacggcgtcgtctttggcgttgtcggcgcgcgtaaccggcagtccgcagaaccattttaccgaaccggcttgacgcttggcccacagggagagttttttgcctttgatttcgttgtttacgttgcttgaagccatttgggcggtaacgacgccgtttttgacttcaacgcttttaacatatttgcctttgatgtcggcggaggttgccacgccggcagaactgttgttgccgggccattcgccgtgattcaggtaatactctgtgacggctgatttttgaccttcagccaaaagaatggcttcgtcattcccgcgcaggcgggaatctaggtctgtcggcacggaaacttatcgggaaaacagtttcttgagattttgcgttctggattcccgctttcgcgggaatgacgggattaaagtttcaaaatttattctaaataactgaaattcaacgaactagattcccactttcgtgggaatgacgaattttaggttgctgtttttgtgggaatgatgaaattttaagttttaggaatttatcgaaaaaacagaaaccgctccgccgtcattcccgcgcaggcgggaatccagcctcgtcggtacggaaacttatcgggtaaaaaggtttctctagtttggtgtcgattttcttgtcgatgctgttgacggcaggtgcttggtgtcgatctgcttgccgttggcggcggtgtcggctttgacggcgtcggcgctggcgttgtcgcgcttaaccggctgtccgtagaaccattttaccgaaccgtcttgacgcttggcccacagggagagttttttgccttggatttctttgtttacgccgcttgaaagcattgtggcggtaacgacgccgtttttgacttcaactttctcaacatatttgcctttgatgttggcggaggttgccacgccggcagaactgttgttgccgggccattcgccgtgattcaggtaatactcggtgacggctgatttttgaccttcagccaaaagaatggcttcgtcattcccgcgcaggcgggaatctagaccttagaacaacagcaatattcaaagattatctgaaagtccgggattctagattcccactttcgtgggaatgacgaattttaggttgctgtttttggttttctgtttttgagggaatgatgaaattttaagttttaggaatttatcagaaaaaacagaaaccgctccgccgtcattcccgcgcaggcgggaatccaggtctgtcggtacggaaacttatcgggtaaaacggtttctctagtttggtgtcgattttcttgtcggtgctgttgacggcaggtgcttggtgttgatgttggcggtgcccttgccggtggcggcggtgacggcgtcgtctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaactgttgtcgccgggccattcgccgtgattcaggtaatactcggtaacggctgatttttgaccttcgaccaaaaggatagcttcgtcattcccgcgcaggcgggaatccagccttgtcggtacggaaacttatcgggtaaaacggtttctttagattttgcgttctggattcccactttcgtgggaatgacgggattaaagtttcaaaatttattctaaataactgaaactcaacgaactagattcccgcttttgcgggaatgacgaattttaggtttctgttttgggttttctgtttttgagggaatgatgaaattttaggtttctgtttttggttttctgtccttgtgggaatgatgaaattttaagttttaggaatttatcggaaaaaacagaaaccgctccgccgtcattcccgcgcaggcgggaatccagcctcgtcggtgcggaaacttatcgggaaaacggtttctttagattttacgttctggattcctactttcgtgggaaagacgaattttaggtttctgtttttggttttctgtccttgtgggaatgatgaaaatttaagttttaggaatttatcggaaaaaacagaaaccgctctgccgtcattcccgcaaaagcgggaatccagcctcgtcggtgcggaaacttatcgggtaaaaaggtttctttagtttggtgtcgattttgtcggtgccggtggcggcggcaacgtcgtctttggcgttgtcggcgcgcgtaaccggctgtccgcagaaccattttaccgaaccggcttgacgcttggcccacagggagagttttttgcctttgatttcgttgtttacgccggttgaaagcattgtggcggtaacgacgccgtttttgacttcaacttccttaacatatttgcctttgattgttgaagaagatgccacgccggcggcatcattaaatcccgtcattcccactttcgtgggaatgacgggattaaagtttcaaaatttattctaaataactgaaactcaacgaactagattcccgcttttgcgggaatgacgaattttaggttgctgtttttggttttctgtccttgcgggaatgatgaaattttaagttttaggaatttatcgaaaaaacagaaaccgctccgccgtcattcccgcgcaggcgggaatccagcctcgtcggtgcggaaacttatcgggaaaacggtttcttgagattttgcgttctggattcccgctttcgtgggaatgacggtttaggtatttttatagaaagccgtaggtggtgtttctatgcaaacgacagatgaagcgtcgcggcaggttgacggcaggtgcttggtgttgatgttgtcggcggtcttggcggcggcggcgacggtgtcggctttggcgtcggtgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgttgccgggccattcgccgtgattcaggtaatactctgtgacggctgatttttgaccttcggccaaaaggatagcttcgtcattcccgcgcaggcgggaatccaggtctgtcggtacggaaacttatcgggtaaaacggtttctttagattttgcgttctggattcccactttcgcgggaatgacgggattaaagtttcaaaatttattctaaataactgaaaccaacgaactagattcccacttttgcgggaatgacgaagtttttctgccatttgccgtgattcgggcaatactcggtaacggctgattttttgaaagtgtttgaaatcggcgcgtggtgtttctatgcaaccggtagatgaatcatcgcggcaggttgacggcaggtgcttggtgttgattttgtcgtcggtcttgccgttggcggcggcgacgtcggtggcggtggcggtggcggtgtcgttgcgcgtaaccggctgtccgcagaaccatttgaccgaaccgttttgacgcttggcccacagggagagttttttgcctttgatttctttgtttacgccgcttgaaagcattgtggcggtaacgacgccgtttttgacttcaactttctcaacatatttgcctttgatgtcggaggaggatgccacgccggcggcatcattaaatcccgtcattcccgcaaaagcgggaatctagaactcaggaccggagaaacctttttacccgataagtttccgtgccgacagacctagattcccgcctgcgtgggaatgatgggattaaagtttcaaaatttattctaaataactgaaactcaacgaactagattcccgcttttgcgggaatgacgaattttaggtttctgtttgtgggtttctgttcttgtgggaatgatgaaattttaagttttaggaatttatcggaaaaaacagaaaccgctccgccgtcattcccgcgcaggcgggaatccagccttgtcggtacggaaacttatcgggtaaaaaggtttctctagtttggtgtcgattttcttgtcggtgctgttgacggcaggtgcttggtgttgattttgtcggtgtcgggtgtggcggcggtgacttcgtcggtgccggctttggcgttggcggcgttgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgtttttcggccattcgccgtgattcgggtaatactcgggtgtttttgtgcaaacggcagatgctgcgtcgcggcaggttgacggcaggtgcttggtgttggttttcttgttgccggtgttgtcggcggcgacggtgtcgtcggtgccggcgcgcgtaaccggctgtccgcagaaccattttaccgaaccgttttgacgcttggcccacagggagagttttttgccttggatttctttgtttacgccgcttgaaagcattgtggcggtaacgacgccgtttgcgactgtaacttccttaacatattttcctttgattttagaggaggatgccacgccggcggcatcattaaatcccgtcattcccacgaaagtgggaatctagaactcaggaccggagaaacctttttacccgataagtttccgtgccgacagacctggattcccgcctgcgcgggaatgacgaagtttttcggccattcgccgtgattcgggcaatactcgggtgttttgtgcaaacggcagatgctgcgtcgcggcaggttgacggcaggtgcttggtgtcaatcttcttaccgttggcggcggcggcggcggtaacgtcgtcgttggcggctttggcgttgtcgcgctcaaccggctgtccgcagaaccattttaccgaaccggcttgacgcttggcccacagggagagttttctgcctttgatttctttgtttacgccgcttgaagccattatgtcagacggtattgcccgggcagctttattcgtacactttcagcagctcgacttcaaatatcaaagtggcgtgcgggggaatcacgccgcccgcgccgtgtgcgccgtagcccatttccgaagggatggtcagcttgcgtttgccgccttccttcatgccgccgaagccttcgtcccagcctttgatgacttgtccgacaccgagcgtgatggtcagcggctggcggcggtcgaggctggagtcgaatttggttccgttttccagccaacctgtgtaatgcacggtaatctctttgcctttaactgcttcttttccgaagccttcttgcaagtcttcaataatcaggccgcccatatttgtcctttcgttgcttgttggtcaaaacggcaagggtaacataccgtccgtcgaagtcaaatgccgctcaaacgtcagctgcatcggtgcagctgaaacggctgtgtttgtttgactgttttatttttttcgtaaaggttccatgctttttcatggaaatagaaaacgacggtgttgattaggggttcgaccagcgcaactgctcccgatacgcctatactgcccgtcagtacataggttacactgaaggcgacgctgaaatgcagtgcggcaaaagtcagggttttaagcatcatcctctcccggattggacattgacggagagatgataaagattatcataaggctgcgcggtttaaatttgctatttgttgttagtgtagataaatcgttttttaaataaggataggaattatgaatcataaaaagatcgttgttttggatgcggatactttgcccggccgggtttttcattttgattttccgcacgagcttgcggtttacggtacgacaggtgcggatgaaacggcagaacgggtgcgcgatgcacatattgtcattactaacaaagtgatgatttctgccgatattattgcggctaatccgcagttggagctgattgccgtcagtgcgaccggcgtgaacaatgtcgatattggggcggcgaaggcggccggtgttgcggtatgcaatgtccgcgcatacggaaacgaatcggttgcggaacacgcctttatgctgatgattgcgttaatgcggaatttgcctgcctatcagcgtgatgttgcggcaggattgtgggaaaagtcgccgtttttctgccattacggcgcgccgattcgggatttgaacggcaaaacgctggcggttttcggacgcggcaatatcggacggacgcttgccggatacgcgcaggcattcggtatgggggtggtgtttgccgaacacaaacacgcgtccgctgtgcgtgaaggctatgtttcctttgaagatgcggtacgggctgctgatgtgttgtcgctgcactgtccgctaaacgcccaaactgaaaatatgataggcgaaaacgaattgcggcagatgaagcctggcgcggttttaatcaattgtgggcgcggcgggctggtggatgaaaacgcgctgcttgccgcactcaaatacgggcagatcggtggggcaggtgtcgatgttttgacgaatgagccgcccaaaaacggcaatcccttgctgaatgcacgattacccaatctgattgttacgccgcataccgcgtgggcaagtcgtgaggctttggacaggctgtttgatatattgttggcgaacattcacgcctttgtgaaaggagaggcgcaaaaccgcgtggtttgaacctgtcgggattgcggaaaaaaatgccgtctgaacgcctcaagggttcagacggcatttcttgagattcccgtttaaccgactttgtcgcccggctgcgcgcctgtatccacatccaagagcttcagtttcccgtctgccgtggcggcactcaaaatcatgccttcagatacaccgaattttgccattttgcgcggggcgaagttggcgacggcgatgaccatgcggccgttcaattcggcagggttcgggtaagacgcggcgatgccggagaagatgatgcgtttttcaaaaccgaaatcgaggtcgaatttcaaaagtttggtgctgccttcgacagcttcgcagttcaatactttggcaacgcgcatgtcgattttcataaagtcgtcgaaactcgcctgttcggcgactttttcgtatttgccctcttcggcggcaggtgcggctgcggcggcgatgctttgtttgttggcttcgattaaatcgtccacttgtttttgctccactcgttgcattaaatgttcgtatttgttgatggcgtgtttgcccaaggtatcgcgtgtatttgcccaagtgatggcttccaaattcaggaatttggcggcgtttgcggcggtttgcggcaagacgggggcgaggtaggcggtcaacatggtgaaggcgttgatgagttcgctgcatacttcgtgcaggcgttcgtcttggccttcttgtttggcgagttcccacggcttgttggcatcaacgtattcgttgacaatgtctgccaaggccatgatgtcgcgcagggctttggcgtattcgcggctttcgtagcattcggcaatggcttcgctttgcgcagtcagttttgccagcaattcgctgtcggcaacatctttcagacggccttcaaagcgtttggcgatgaaacctgaggcgcgggcggcgatgttgacgtatttgccgacgaggtcgctgtttacgcggctgataaagtcttgcaggttcaaatcgatgtcttcgattttgctgttgagtttggcggcgatgtagtagcgcatccactcggggttcaggccttgttccagataggatttggcggtaataaacgtgccgcgcgatttggacattttttgtccgtcgacggtcaaaaagccgtgtgcgtacacgccggtcggggcgcggtggccggagaaatgcagcatagcgggccagaacagggcgtggaaatagagaatatctttgccgatgaagtggtacatctcggtttggctgtcggctttgaagtattcgtcaaaatcgacgccgatgcggtcgcacaggtttttaaacgacgccatgtagccgacgggcgcgtccagccagacgtagaagtatttgcccggcgcgtcggggatttcaaaaccgaaatacggcgcgtcgcgggaaatatcccagtcggacagggtggtttcttcaccttcgcccagccattctttcattttgttgagggcttcggcttgcagatggggcttgccgtcgtgcgggttgttgccggaagtccatgctttgaggaagtcggcgcattcgcccagtttgaagaagaagtgttcggattcgcgcaattcgggtttcgtaccggaaacggcggaatacgggttaatcagttcggtcggggaataggtcgtgccgcagacttcgcagttgtcgccgtattggtcttgggcgtggcatttcgggcattcgcctttgacgaagcggtcgggcaggaacatttgtttttcggggtcgaaaagctgctcgatgacgcggctctcaatcttgccgttggctttcagcgcgcggtaaatgtcttgggaaaactgtttgttttcaggggaatgggtgctgtaataattgtcgtaaccgatgaaaaagccagtaaagtcggcgaggtgctcttcgcgcactttggcaatcatgtcttcgggcgcgataccttgtttttgcgcggcaagcattacgggcgtgccgtgggtgtcgtcggcgcagcagtagtggcacgcgtggccgcgcagtttttgaaagcgcacccaaacgtcggtttggatgtgttcgaccatgtggccgaggtggatgctgccgttggcatagggcagggcggaggtaactaagattttgcgtgtcatattgtgctttgcaaacaatgggtaaaggcggattataccgcaaatcaaacggggaaatgccgtctgaagcctgaaaaatcgggcttcagacggcatttttgccaaccggcgggagttattcgacggttacggatttcgccaggttgcgcggcttgtccacatcggtaccgcgtgcgagggcggtgtggtaggcgaggagctgcacggggatagtatgcacgacgggggacagtttgccgacgtggcgcggtgcgcggataacgtgcacaccttcggtggcattaaaattgctgtcgaggtcggcaaagacgaaaagttcgccgccgcgcgcgccgacttcctgcatattggctttgactttgtccaacaggctgtcgttgggtgcgatgacgacgacgggcatattttcgtccaccagggcaagcggcccgtgcttcagttcgccggcaggataggcttcggcgtggatgtaggtgatttccttcagcttcaacgcaccttcgagggcaatcgggtaatggatgccgcgccctaaaaacagcgcgctggttttcttggcaaactgttgcgcccatgcggcaatttgaggttcgaggttcagagcgtgctgcacgctgccgggaagctggcggagttcttcggtgtaacgcgcttcgtcttcttcggaaaccaaaccgcgcactttcgccagcgttaccgccaaaccgaacagcgcaaccagttgcgtggtaaacgctttggtcgaggcgacgccgatttccgcaccggcacgggtataaagcacgaggctgctttcgcgcggcagggcggattccatcacgttgcaaatggagaggctgtggcggtgtcccaaggatttggcgtatttcaacgcctccatcgtgtccagcgtttcgccggattgggaaatggtaatgaccagttggtcggaatcagcaatcacgctgcggtatcggtattcgctggcgatttcgacgtcggacgggatttttgcgatggattccaaccaatatttggcggtcagcgcggcgtaataggacgtgccgcaggcaaggattttgacgctgcggatgctttcaaacacgcttttggcatctttgccgaagttttcggggatgaagccgccgtcgaggaaaacctccgccgtgtctgcaatcgcgcggggctgctcgtggatttctttttgcataaagtggctgtacagtcccagttccaaagaggcgagcgagagttcggataccttgactttgcgttcggcaggcaggccgtttttatcggtcagccttttgatgccgtctgaagccagcagcgcgatgtcgccgtcttcgaggtacgccacgcggcgcgtaaaggcgatgacggcggatacgtccgaagcgataaaggtttcatcgtcgcccaaagcgaccaaaagcgggcagcccatacgcgccacaactaattcatcaggcttgtcttgggcaataaccgcgatggcgtatgcgccgtggaaacgtttgaccgcttcttgtaccgcttcaaacagcctgccgccgttttgcgcgtattcgtgattgatgctgtgtgcgatgacttcggtatccgtttgcgattcaaaacggtatcccaaaccttccaaacgtttgcgttcgctttcaaagttttcgatgatgccgttgtgtacgaccgcaatcataccgccgctgatgtgcgggtgggcgttcggctcagtaacgccgccgtgtgtcgcccaacgcgtatgtccgatgccgatgccgccgctgatgcctttttcgcgtgccgcgtcctccataagctgcacgcgtccgacgcggcgcacacgtttgattttgccgtcggtgttgacggcaatgcctgatgagtcataaccccggtattcgaggcgtttgagaccgtcggtcagaaaatcgacgacgttgtgatgggcgcggatggcgccgacgataccgcacataactgttccttagtatccggttgaaaaaaaacaggcgcggacggcttccgtgccgcaccttcctcttcggattataaaccgcctcccgcgccggaaaacagcaaaatgccgtctgaaggcttgggcttgctcaaaaaaaggagggatttccctgtttatccaggatgggcgttcagacggcattacctgctgctggtttatagtttttgcaaatcaacattgacaagctgaaaaaaaaaaacaatatactcgctcggtcttaatgttaacggagtatggaaatgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttagtaggggacaaccgggaggatgccgccgtccgaatcggatgtgcggtttctgtaccggtacgggcgggcaggaatgtccgccttttttgttcggatgcgtttgaatacccgtttgattccgaccgtttgcaaggggtatttccgttcgggcggaaattatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttaaatttgatccactataattccgtcaaataagaaaggaattttgtgcctgcggtatcgcaaaacttcgccttaatgcgcccgattgcctagggatgggcttcagatggcattgttttccggtttacgggcggtattcgggcttcataccgttgggtaggagctgccagacatatcccgtggttttctgtttgccggcaagttcgccggcttcgtcgccgtatccccaaaaataatccacgcgcaccgcgcctttaatcgcgctgccggtatcctgcgccataatcaggcggttgagggctttgcgggtaaccggatgggcggtggcgacaaataagggcgcacccaaggtaatgtagtgccggtcgactgcgccggcatattcccccatcagcggcgtgcccagtgcgccgacagggccgtcattgctgcttccggcaagctcgcggaaaaagatatagctggggttttgacccaaaacttcggcgaggcgttgcggattttgccgcatataagacttaatgccctgcatggaggtttgtccgagtttgaggtagcccttatccgccatatagcgtccgatggaaacgtagggatgttcgtttttgtcggcatagccgatgcggatgtatttgccggacggggttttcagacggcccgagccttggatgtgcataaaaaaaagttcgacagggtcttcggcgtaaccgagtatcggggctttgccgtcaagcgcgccgccgttgatttggttgcgcgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaggcagggggacggagataaaatcgtcgggaataccgtaaatcgggaagcgggcttgtgccgtccgcctgtcgtcgcccttcagcaccggttcgtaatagccggtaaccgtaccggcaaggcttccgttgcctgcaacctgccacggcgtgaaatagcgttcaaaaaactgttttgcctgaaaggaatggacgggggtttgaaaggcttgggcgcacacatcctgccagccttggcggtttttcaaattggcgcagccgaggcggaaggattgcaggcttttggcgaaatcctgcgccgcccagtggggcagggacaggtgcggtacaacggtatagacggccccgccgccgccgaccgtcgttccggcggggtcggggatgccgaccggccggtccgggccgttgatgacggatgtgtcgggttgcggaaaggtttggatgctcttgctttggcaggcggcgaggatggcggcggcgatgccgtacagggcggcgcggaataggtattttttcataatggacaatgttgccggcagtaataagaaagatggtttcgggcggcgttgcggcagccgtggagaggggattttaacacagggcgcagctgcagcctgcggaactttccgccgcgcggtactgcagataaaaataacttgcatttgtatttacaagcaatgaaaatattccgataatatattattcatcatccttgttcgttcgcgtttatgctggtcgcttttttaattatgttgcgcgagggtattgaagccgcgctcattgtcggcatcgttgccggttttctgaaacagtccggacattccaaactgatgcctaaggtctggttcggggtcgtccttgcttctttgatgtgtttggggctggggtacggcatccattcggcaacgggcgagattccccagaagcagcaggagttcgtcgtcggcattatcggtttggttgccgttgccatgctgacttatatgattttatggatgaaaaaggcggcgcgttcgatgaagcggcagcttcaggattctgtgcaggcggctttgaaccgtggcagcggtcaaggatgggccttggtcggtatggcgtttcttgccgtggcgcgcgaaggtctggagagtgtttttttcctgcttgccgtattcaaacagagcccgacgtggcagatgccggccggcgcggtagcgggggttttggctgccgccgtgattggcgcgttgatttatcagggcgggatgcgcctgaatctggcgaagtttttccgttggacgggggcgtttctgattgtcgttgccgccggcctgcttgccggctcgctgcgcgcgctgcatgaggcaggtatttggaacgcgcttcaggacattgtgttcgactcatcaaaatatttgcacgaagacagtccgttgggcgtgctgctcggcggatttttcggctataccgaccatccgacgcagggcgagaccttggtttggctgctgtaccttattcccgtcataacttggtttttgtgcggcagcaggccgtctgaaactttaacccgtaaagaggagctgaaatgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctacgttcaaggcgaggttaaagagctggtggcgaaaaccaaaacttttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggctttcaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatctaaaaaaatcgtcgatttgttccgtccgctgatcgaggccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataagccgcaagcgttcagacggtatttggcggcagataccgtctgaagttttatagtggattaacaaaaaccagtacggcattgcctcgccttgccttgccgtactatttatactgtctgcggcttcgtcgccttgtcctgatttttgttaatccactatatccgccatatattgcagggcgggatttcaacctgccgctatcggttaatggaaaaacggcgtgcagggatacccatcctgctgcacggatattgaaggaaacaccatgagcaaaaaacaacccgcacaaccgaccaggcgcactctttttaaaaccgcgatcgcagccggagcagtcggcgcaatcggaggttatctcggcggcaaaaaacagggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgttggagtatcgacgggtggcagcccaaatccgaacccggcgcgatggcggcgcgcaacctgttgggcttcagggacggcacgggcaaccccaaagtttccgatcccaaaactgccgacgaggttttgtggacgggggtggccgccaacagcctcgacgaaccggagtgggcgaaaaacggcagctatcaggcagtccgccttatccgccactttgtcgagttttgggacaggacgccgcttcaagagcaaaccgacattttcgggcggcgcaaatacagcggtgcgccgatggacggcaaaaaagaagccgaccaaccggattttgccaaagaccccgagggtgatatcacgcccaaagacagccatatacgcctggcgaatccgcgcgatcccgaattcctcaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataaatccgccatataaaaaacgccgtccgaaccttgccaaacgggttcggacggcgtttcttgtttttgggcggtcaggcttttttgacgaattcggattttaaattcatcgcgctgccgtcgattttgcagccgatgttgtgatcgccttcttgcaggcgtatgcctttgacttttgtgccttgtttgatcaccatcgagctgccttttaccttgaggtctttgatgaggatgacggtatcgccgttttgcagcactgcgccgttggcatcgcgcacttgagccgcaaggtcggcggcggattcggtttcattccattcatgggcgcattcggggcagatgtattgtccgccgtcttcataggtgtattcggaggcgcattgcgggcatgggggtaatgacatggtttgccgtccttatcggatgtttgttttggggtgccgtctgaaacctgaaaccggcttcagacggcatagctttattgtttgtctttttcaggacgcacccagccttcgatgacggtttggcgggcgcgggcgagggcgagtttgttgtcttcgacattgcgggtaatcgtgctgcccgcgcctgtggttactttgttgccgagggtaacgggggcgactaggacgcagtttgaaccgatgcgcacttcgtcgccgatgacggttttgtgtttgtgcacgccgtcgtagttggcaataatcgtaccggcgccgaagttggttttgcagccgacttcggcgtcgccgatgtaggtgaggtggttggctttggtgcctttgccgatggcggcgtttttgatttcgacgaagttgccgacgtgtacgtcgtctgcaaggcgggcttgcggacgcaggcgggcgtacgggccgattcggttgttttcgccgacttcgcagctttcgaggtgggagaagggggcgattttgctgtttgcgccgattttggcgtttttgatgacgcagtttgcgccgatttcgacgttgtcgccgagctcgatgtcgccttcaaagatacagttcacatcaatcacgacgtcttgcccgtgtttcagacggcctcgtaaatcgaaacgtgccggatcgcgcagggttacgcctgctttgagcaattcttgcgcctgttcggtttggaagatgcgttcgagttcggtgagctggagtttgttgttcacgccggcggcgaggtgggaggcgcgcacttggacgggatgaactttaataccgtcggcaacggctttggcgatgaggtcggtcaggtagtattcgccttgtgcattgttgctggaaaggctgttcagccagttttcgagtttggcgttgggcaggacgaggatgccggtattgatttctttcacggctttttggacggcgtcggcgtctttttcttcgacgatggcggttacgctgccgttgctgtcgcggatgatacgccccaagcctgtcgggtcgttgggaacgtcggtcaacagcccgacttcgttgcctgcggcttcgagcagggtttcgagggtttcaacgtcaattaaaggaacgtcgccgtacaacaccagcgtgcggccttcggcggaaaggtggggcagggcggttttgacggcgtggccggtaccgagctgttcggtttgttcaacccaaacgacatcgcgtttgacggtgtccaagacttgctctttgccgtggccgatgacgacgcagatgttttgcggattcagtgcggctgcggtgtcgataacgcgcccgaccatgggcttgccgccgatgcggtgcagcacttttggcattttggaatacatgcgcgtgcctttgccggcggcgaggatgacgatgtttaaagtgttttgcggcatgacggtttcctgtgcaatgccgtctgaagcggcttcagacggcatagggtaggtttatcggttttgaaactttggtttttgccagtgttggcgatgctcttcgtcggcgttgttgccggtttgattgggtaacacggcatggcgttcgggacggtattggttgtagttcatatttttcgagtagctgccgtcttggtaataaacgggcgtgccggcgggatatttttgacggacggcggtcttgccgttgccgtcttgataagtttcccacgcgcagcccgacaaaagggcggcggcagcggtcaggaagaggaaggttttacgcatggcttttctttcgtattttcggggggtagggggtattgtaatgattttggcggtgttctgacaaagtttctgcataccgagccagttgcgccatatcgcttacggaggcatcgataaagggcagcgcgtgggattttgcaccgaaccggacggttttcatacccagcgcctttgcctgatgcaggttgtccgcgctgtcgtccaccataatgcagcattcgggcggtacgtccaacaggcggcagacattgagatacgcttgcggattgggtttgtacagcagcccgaaatcatccgtgccgaaaagcgcgtcgaaacggttttccaaaccgagtgcgttgacaacggcacggacgtaaaacgacgggccgttggaaaaaaccgccttgcgcccttttaggcggctcagggtgttttgtgtttcaggcatgccgtgcagcctggtcaggattgcatcgatcggatggctttcgcgcaaaaattcggcgatgtcgatttcgggatggtggatttgcagtccggcgagcgttgcgccgtagcggtgccaatagtcttgacgcaggtcggacgcggcagattcggagagtttgaggcggcgtgccatatagcgtgtcatagcgcggttgatgagtgtgaagatgcctgcgtcggcatcgtgcagcgtgttgtcgaggtcgaacagccacacggtcgggttttcttgcatgttgaaccgtgaaaatttgttagaatgttattttacagcgaatagaggaggactcggaatgaaacggaaaatttggctgctgccgctgctggcggtttcggcatacctgcaggcgcagacggaagtcaggctggcggtgcataagtcgttcagcctgcccaaagggttgattgcgcgcttcgagcgggcaaacgatgcgaaggtgtcgattattcaggcgggcggcgcgaacgaaatgctcaacaaactgattttgagccgcgccaacccgattgccgacgcggtgtatggtttggacaacgccaatatcggcaaggcgcgggaaatgggcattttggcggcggcgcaacccgaatccgcccccgtcgcggtcgggctgccttcggctttggcggtcgattacggctatgtgtccatcaattacgacaaaaaatggtttgaaggcaaaaagctgcccctgccgcaaaccctgcaggatttgacccgccccgaatataaaaacctattggtcgtgccgtcccccgccacgtcgtccccggggctgggcttcctgatggcgaacatcagcggtctgggcgaagaaagcgcgttcaaatggtgggcacagatgcggcagaacggcgtgaaggtcgccaaaggctggagcgaggcgtattacaccgacttttcgcacaacggcggcgcgtatccgctggtggtcggttatgccgccagcccggcggcggaagtgtatttttccaaaggcaaatacagcgagccgccgacgggcaacctgtttttaaaaggcggcgtattccgccaggtcgaaggcgcggcggtcttgaagggcgcgaaacagccggaattggcggcaaaactggtgcaatggctgcaaagtcgggaagtgcagcaggcggttccgtccgaaatgtgggtttaccccgccgtcaaaaacacgcgcctgcccgacgtgttccgcttcgcccaagccccgacgcacaccaccgcccccgcgcagcgcgatattgatgcgaaccagcgcggatgggtttcccgttggattagaacggttttgaaataaaacaaacatacctccccgcagggcttcatacggcatttttacacctgtgccgattacgccgcacggggcggatgttcgatcaagaggaaaacaatggacttcaaacaatttgattttttacacctgatcagtgtttccggttgggagcatctggctgaaaaggcgtgggcgttcgggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaaacgccgtctgaaagaggagtgggaaatggacgcgctgcacaccatcgcccgaaacctgacgaaaaaacgtcaaaccgtaagctgtgccgaatcctgtacgggcggaatgcttgccgccgcattcacaagcgttgcaggcagttcgcaatggttcgaccagagttttgtaacatacagcaacaaagccaaagaagaccgcttgggcgtgttgcccgaaaccctgctcgaacacggcgcggtcagccgccaaaccgtctatgagatggcgcgcggcgcgaaagccgtggcgcaggcggattacgccgtcggtatttccggcatcgccggtccgggcggcggcagcgaaagcaaacccgtcggcacggtttggttcgggtttgcctttccgggcggaagttgcgaagcaatgcgccgttttgacggcaaccgcgaatccgtccgcgcgcaggcggtcgccttcgcgttggaacggttggcggggctgattgaaaacggcggcgatgctgtctaaacaaaatctccgtctgaacaaaatccccatcggataaaaaatgccgtctgaaacgtttcgggtttcagacggcattttgtcggggtaggcggcggtgcggcttatttcactttacctttcaacgcgccatagcctgccgcgtccatttgttccagcgggatgaatttcaagctcgcgccgttgatgcagtagcgcagtccgcctttgtcgcgcgggccgtcggggaagacgtgtcccaaatgcgagtcggcggcgtggctgcgcacttcggtgcggcgcatgttgtagctgaaatcatcgtgttcggtaacggattttgcatcaatcgggcgcgtgaagctcggccagccgcagccggaatcatatttgtcggcggagctgaacaaaggttcgccgctgacaacgtccacataaatgccgggtttgaacaaatggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggggcggtcttggttttgcccggcagcggttcgtcagctttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtaaatggtgcgcgtgttcatgatttttgaatcctttttctgagtgtcgggtttgtagaacgaatgtttcaagctgcccaaatcggcattcgggtcgcggattaacgccaacgcctgcgcttcgttgatgctgcctttgacgatgcgctgcacgtcgctgtctttaccgattaacgcccacgaggggtaaacgctgatattcaggctttgggcgatcgtgccgccgttgtcggttacgacgggcagcttgggataattcaaaccggcataccatttttggaagtcgccgtcttttttctcgtgcaaaaagcccggggaggcgacggtaatcaggttggcggagctgaattttgcatcttgcgcccatttttcggtctgtcccaattcggacagacacaaaggacaccagctcgcccaaaatttaatcagcgtcggtttgtcttttttcaagtaaacactggcggggcggttgtccgcagttttcaaagtggataaagtgtgcggcacggtcgcggctccggcatcgacgattttgggcgaacaagcacccagcgcaagcaggcagccgaacttggcgcaaagggaaaagaaagtacggtgtttcattttgatgtttcctgtgtggacggtttgcatgattagacgtttgagatgccgaaaccttacagcccggattttcagacaaccttaccgcgtaaaatacgctacaatacgccctgtttcaagtttctaaaattaaaaggaaaattcaatgttcagcttcttccgtcgcaagaaaaaacaggaaacgccggctctcgaggaggctcaaattcaggaaaccgcagcaaaagcagaatctgaacttgctcaaatagttgaaaatattaaagaagatgctgaatctttagcagaaagcgtcaaagggcaggtcgaatctgccgttgaaaccgtcagcggtgcggttgaacaggtaaaggaaaccgttgccgagatgctgtctgaagcagaggaagcggcggaaaaagcagcggaacaagtcgaagcggcaaaagaagccgttgccgaaaccgtcggcgaggctgtcgggcaagttcaagaagccgttgcgacaactgaagaacacaagctcggttgggcggcgcgtttgaaacaaggcctgaccaaatcgcgcgacaaaatggcgaaatcgctggcgggcgtgttcggcggcggacaaatcgacgaagatttatacgaagagctggaaaccgtgctgattaccagcgatatgggcatggaagccaccgaatacctgatgaaagacgtgcgcgaccgcgtcagcctcaaagggctgaaagacggcaacgaattgcgcggcgcgttgaaagaagccttgtacgacctgattaagcctctggagaaacctttggttttgcccgaaaccaaagagccgtttgtcatcatgcttgccggcatcaacggcgcgggcaaaaccacgtctatcggtaaactcgccaaatatttccaagcgcagggcaaatccgtattgctggcggcaggcgatactttccgtgccgccgcgcgtgagcagcttcaagcttggggcgagcgcaacaacgtaaccgtgatttcgcaaaccacgggcgattccgccgccgtgtgcttcgatgccgtccaagccgccaaagcgcgcggcatcgacattgtgctggccgacaccgccggccgcctgcccacgcagcttcatttgatggaagaaatcaaaaaagtgaaacgcgtgctgcaaaaagccatgcccgacgcgccgcacgaaatcatcgtcgtgcttgatgccaatatcgggcaaaacgccgtcaaccaagtcaaagcctttgacgacgcattggggctgaccggtttaatcgttaccaaactcgacggcacggcaaaaggcggcatcctcgccgcgcttgcctccgaccgccccgttcccgtccgctatatcggcgtgggcgaaggcatagacgacctgcgcccgtttgacgcgcgcgcgtttgtggacgcactgctggattgagccgaaatgccgtccgaaaacagcagaccgatgccgtcattcccgcgcaggcgggaatccagaccttgggataacggcaatattcaaaggttatctgaaagtccgagattctggattcccactttcgtgggaatgacgggatgtaggttcgtgggaatgacgtggtgcaggtttccgtatggatggattcgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatctaggtttgtcggtgcggaaacttatcgggtaaaacggtttctttagattttgcgttctagattcccactttcgcgggaatgacgaagagttgcgggaatgatggaaagctatgggaataacgaagggttaaagtaatcacgggatggtgttcgcgggaatataaattgaaataattcaaaagggtattatatgcagcctgcggtttatattttagcaagccaacgtaatggcacgttatacattggcgttacatctgatttggtgcaacgtatttaccaacatagggagcatttgattgagggatttacatcacggtacaacgttactatgctggtttggtatgaactgcatcctacgatggagagtgcaattactcgggaaaaacagttgaagaaatggaacagggcttggaaattgcaactgattgaagaaaataatgtttcttggcaggatttatggtttgatattatttagcccgtcattcccgcgcaggcgggaatccggcttgttcggtttcggttttttttttgaggtttcgggcaacttctaaaccgtcattcccgcgtaggcgggaatctagaccttgggataacggcaatattcaaagtttataaaagacccgttattcccgcgcaggcgggaatctagaccttagaacaacagtaatattcaaaggttagctgaagctttagagattctagattcccactttcgtgggaatgacgggatgtaggttcgcgggaatgacgggatttgagattgcggcatttatcggaaaaaacagaaaccgttctgccgtcattcccgcgcaggcgggaatccggcttgttcggtttcggtttttttgaggtttcgggcaacttctaaaccgtcattcccgcgcaggcgggaatctagaccattggacagcggcaatattcaaagattatctgaaagtccgagattctagattcccactttcgtgggaatgacgggatgtaggttcgtgggaatgacgggatttgagattgcggcatttatcggaaaaaacagaaaccgctctgccgtcattcccgcgcaggcgggaatccggcttgttcggtttcggttttttttttttttgaggtttcgggcaacttctaaaccgtcattcccgcgcaggcgggaatccagaccattggacagcagcaatattcaaagattatctgaaagtccgggattctagattcccactttcgtgggaatgacgggatgtaggttcgtgggaatgacgggatttgagattgcggcatttatcggaaaaacagcaaccgctccgccgtcattcccgcgcaggcgggaatctagaccttgggataacagcaatattcaaaggttagctgaagctttagagattctggattcccactttcgtgggaatgacggaatgtaggttcgtgggaatgacgggatttgagattgcggcatttatcggaaaaacagcaaccgctccgccgtcattcccgcgcaggcgggaatctagaccttgggataacagcaatattcaaaggttagctgaagctttagagattctggattcccactttcgtgggaatgacggaatgtaggttcgtgggaatgacgggattagagtttcaaaatttattctaaatagctgaaactcaacgcactggattcccgcctgcgcgggaatgacgaattttaggtttctgattttggttttctgtttttgagggaatgacgggatttgagattgcggcatttatcgggagcaacagaaaccgctccgccgtcattcccgcgcaggcgggaatctagaccttagaacaacagcaatattcaaaggttagctgaagctttagagattctagattcccactttcgtgggaatgacggaatgtaggttcgtgggaatgacgcggtgcaggtttccgtatggatgggttcgtcattcccgcgcaggcgggaatccggcttgttcggtttcggttttttttttttgaggtttcgggcaacttctaaaccgtcattcccgcgcaggcgggaatctagaccttagaacaacagcaatattcaaagattataaaagacctgtcattcccgcgcaggcgggaatctaggtctgtcggcacggaaacttatcgggtaaacggtttcttgagattccgcgtcctggattcccactttcgtgggaatgacgggatgtaggttcgtgggaatgacgcggtgcaggtttccgtatggatgggttcgtcattcccgcgcaggcgggaatctagaccttagaataacagcaatattcaaagattatctgaaagtccgagattctggattcccactttcgtgggaatgacggaatgtaggttcgcgggaatgacgcggtgcaggtttccgtgaggatggattcgtcattcccgcgcaggcgggaatctagaccttagaacaacagcaatattcaaagattataaaagacctgtcattcccgcgcaggcgggaatccagaccttagaacaacagcaatattcaaaggttagctgaagctttagagattctggattcccactttcgtgggaatgacgggatgtaggttcgtgggaatgacgcggtgcaggtttccgtgcggatggattcgtcattcccgcgcaggcgggaatccagaccttgggataacagcaatattcaaaggttataaaagacccgtcattcccgcgcaggcgggaatctagaccttagaacaacagtaatattcaaaggttagctgaagctttagagattctggattcccactttcgtgggaatgacgggattagagtttcaaaatttattctaaatagctgaaactcaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgtaggcgggaatccagaccgttgggcatctgcagcggtttgctaaaaaccgctttactgtgataagtgcgcagggttagaatggcgcggtaaccttatatattgtaccccgtcaaaggggcgcattgcttttcttaacattcccctttggcagccaagtgaaagggcttttcaatcagcaattcggcgggcgcggaatcgggcggtttaccgaaccccggcgttcgcggcgcgccgccccgtcccgtgaaggcaaactcaaggaataaaagatgaataaaacttggaaacggcaggttttccgccataccgcgctttataccgccatattgatgttttcccataccggcgggggggggggcaggcgcaagcgcaaacgcaaacgcaaacgcataaatacgctattgtaatgaacgcgcaaaatctgcccgaggtaaagtggggggatcaatatcagtcattgacgcacaaaagcaatgaacgcgaagttatccatacgagtggttttggtttggcaaaaaagagcattagtttctcattcaataataccgatgaagttgttgctgaaaaaaaagatactgtcgttttcggcgcggcgacctacctgccgccctacggaaaggtttccggttttgataccgctaagctgaccgagcgcaaaaatgcccttgatcagattggtacgaccaaaacggggctggtaggctacagctacgaaggtagcacatgctccagcggaggttgtcctacagttgcctatagaacccaatttaccttcggcaattccagtttggcaaaaaaggcaaacggcggcgggctggatatatacgaagacaaaagccgcgacaattcgcccatttacaaattgaaggatcatccttggttgggcgtgtctttcaatttgggcggagagagctccttcaaaccaaagagacaaggttctttggtatcttcttttagcgaggacgtgacgcagcaaaatggtgcgggcagccaacacaaagacaaaaacctcgtttatacgacagacgattacaagagtcagaataataaaaaccatcaggacaaacaccacgccgtcgccttttatctgaacgccaagctgcacctgctggataaaaaacacattaaaaatatcgtgcaaggtaaaacagttaatttgggtatcttgaaaacacgcatcgagccgacggaagcatggaaaagacggaatagtaacttttttaacggtagttggacgtatgaagagaaaggaacagtcagcgtcaaactcaaattgccggaagtcaaagcaggccgctgcatcaacgcaaataaccccaataagagtaccaaagccccttcccccgcactgactgcccccgcgctgtggttcggacctgtgcaaaatggtaaggtgcagatgtattccgcttcggtttccacctaccccgatagttcgagcagccgcatcttccttcaaaatctgaaaagaaaaaccgaccccaacaaacccggccgccattccctcgcagacttggctaagtcggatattgaaaatcgacagccgaatttcacagggcggcaaaccatcatccgattggatggcggcgtacagcagatcaaactgggtagaaacaatgatgaggtcgccaattttaatggaaatgacggcaaaaacgacactttcggcattgttagtgaagggagcttcatgcctgatgccagcgagtggaaaaaagtattgctgccttggacggttcgtgcttccaatgatgacggtcaatttaacacattcaacaaagaagaaaaagacggcaagccaaaatacagccaaaaataccgcagccgcgacaacggcaagcacgagcgcaatttgggcgacatcgtcaacagccccatcgtggcggtcggcgagtatttggctacttccgccaacgacgggatggtgcatatcttcaaacaaagcggcggggacaagcgcagctacaatctgaagctcagttatatcccgggtacgatgccgcgcaaggatattcaaaacaccgaatccacccttgccaaagagctgcgcgcctttgccgaaaaaagctatgtgggcgaccgctacggcgtggacggcggctttgtcttgcgcaaagtcgaacggaacgggaaagaccatgtgtttatgttcggcgcgatgggctttggcggcagaggcgcgtatgccttggatttaagcaaaatcgacagcggcaacggcaacctggcagacgtttccctgtttgatgtcaaacatgacaagaatggcaataacggcgtgaaattaggctacaccgtcggcacgccgcaaatcggcaaaacccacgacggcaaatacgccgctttcctcgcctccggttatgcgactaaagacattaccagcggcgacaataaaaccgcgctgtatgtgtatgatttggaaagcagcggcacgctgattaaaaaaatcgaagtacccggtggcaagggcgggctttcgtcccccacgctggtggataaagatttggacggcacggtcgatatcgcctatgccggcgatcgcggcggcagtatgtaccgctttgatttgagcaatcaagatcctaatcaatggtctgtacgcgccatttttgaaggcacaaaaccgattacttccgcgcccgctatttcccaactgaaagacaaacgcgtggttatcttcggcacgggcagtgatttgagtgaggatgatgtactcagtacgagcgaacaatatatttacggtatcttcgacgacgatacggtggcgaataacgtaaatgtaaaactcagcggtttgggaggcgggctgctcgagcaagagcttaagcaggaggataaaaccttattcctgaccgattacaagcgatccgacggatcgggcagcaaagggtgggtagtgaaattgaagggcggacagcgcgttaccgtcaaaccgaccgtggtattgcgtaccgcctttgtaaccatccataaatatacgggtacggacaaatgcggcgcggaaaccgccattttgggtatcaataccgccgacggcggcaagctgaccaagaaaagcgcgcgcccgattgtgccggccgagaatcaggctgtcgcgcaatattccggccataagaaaggcatcaacggcaaatccatccctataggttgtatgcaaaaaggcaatgaaatcgtctgcccgaacggatatgtttacgacaaaccggttaatgtgcgttatctggatgaaaagaaaacagacggattttcaacaacggcagacggcgatgcgggcggcagcggtatagaccccgccggcaagcgttccggcaaaaacaaccgctgcttctcccaaaaaggggtgcgcaccctgctgatgaacgatttggacagcttggacattaccggcccgacgtgcggtatgaaacgaatcagctggcgtgaagtcttctactgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagaccttagaacaacagcaatattcaaaggttagctgaagctttagagattctggattcccactttcgtgggaatgacgggatgcaggtttccgtatgaatggattcgtcattcccgcgcaggcgggaatccagaccttagaacaacagtaatattcaaagattatctgaaagtccgagattctggattcccactttcgtgggaatgacgggattttaggtttctgattttggttttctgtttttgtaggaatgatgaaattttgagttttaggaatttaccggaaaaaacagaaaccgttctgtcgtcattcccgcgcaggcgggaatctagacattcaatgctaaggcaatttatcgggaatgactgaaactcaaaaaactggattcccactttcgtgggaatgacgggatttgagattgcggcatttatcgggagcaacagaaaccgctctgccgtcattcccgcgcaggcgggaatccagaccttagaacaacagtaatattcaaagattatctgaaagtccgagattctggattcccgcctgcgcgggaatgacgaattttaggtttctgattttgtttttctgtttttgtgggaatgatgaaattttgagttttaggaatttatcggaaaaaacagaaaccgctctgccgtcattcccgcgcaggcgggaatctagaccttagaacaacagcaatattcaaagattatctgaaagtctgagattctagattcccactttcgtgggaatgacgggatgtaggttcgtgggaatgacgtggtgcaggttcgtgggaatgacgtggtgcaggttcgtaggaatgacgtggtgcaggtttccgtgcggatggattcgtcattcccgcgcaggcgggaatctagaccttagaacaacagcaatattcaaaggttatctgaaagtccgagattctggattcccactttcgtgggaatggcgcgattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgacgggatgcaggtttccgtacggatggattcgtcattcccgcgcaggcgggaatctagacattcaatgctaaggcaatttatcgggaatgactgaaactcaaaaaactggattcccactttcgtgggaatgacgggattagagtttcaaaatttattctaaatagctgaagctcaacgcactggattcccgcctgcgcgggaatgacgaagtggaagttacccgaaacttaaaacaagcgaaaccgaacgaactggattcccattgtcgtggaaatgacgggattttaggtttctgtttttggttttctgttttcgtgggaatgacgggatgtaggttcgtgggaatgacggttcagttgctacgcatttaccctgcgcaaagctttatccactatcttgtaacctgtctgacaatctgtcctctcttacaaaatgccgaaactttttcaggctgcattttggggctgcctgtgcggaatttggcggtaggcgcggtagtagggttcgagctgtcgggcgatgagttggagctgttggaggaggatgtggctttgtgttccgctgctgtgggtgcggagggtgtcgagttcgccgcgcagtgtatccagtgctgtctgaaagtcgtcgggttcggtttcgggcaggtgttggaagatgtgggcggtgtgttcggcggcgaggtggaactgtgcggtaaagtcggggctgcattcttcgtgcatttcgctgcggtatgcgccgagggcggagatgtagccggtcagggcgtagccggttttgagcagggtaaagccgggttgcaggctgtcggcgaattttgcgggttcgctgctcatgtcggaaagggtgctgctgagggcggcggtgtgttcgtgggcgcggcggcgggtggcgcggtattcgacgtcgtcgccggtttcgccgcttttgaggcgttcggtgattttttcgagataggcaccgttgctgcatacggcaagggcggcggtgcgttcgagcgtgaggtatttccagtctggccacaggtagctgactgccgcccaggcaagggatgcgccgataatggtgtcgatgatgcgtacgggcatggcggcgtatacgtccaaacctgcgagggagaggctggtcagggcttgaatggtaatgaagaaggtggagaaactgtatttgtaggtgcgggtcatgaaaaagagggtggtactggcgatgacaatccagagtttggtttcgacagacggggtgaagtaggggacgagcgagccgacgattacgccgagtacggtgccggcgatgcgctggcggacgcggcttttggtggcggtgtagttgggttggcagacgaaaagggcggtcagtagtatccagtagccgaggttgaggttgagggcttcgacgatggtgcaggcggcggcaacgacgagggacaggcggacggcatggcggaatacgcctgattcgaggtttagctgcggacggattgcctgccaggtgtttttgaggctgctggtttcgagggcggcgatgcgggtgtcgcccatgcggtcgttttctgcctgcaggccgttgtgctggagttggcggaactgctggtcgacgctgccgaggttgtcgagaaggcggcgcaggtggcggatgtcgggactgtcgttgctgtctgaaaggaggcgcagcgattggcggcagccttcgatggcgcggccgaggcgtttgctgtaaacgtagtctttgcttgcgcgcagggcttgggcggtgttgcggcaggcttgtccctgcatttcgagcaggcggtggatgcggaagatgatgtcggtgtttttgaatttttcggacatttcctgataatcgacgtgggcggagctgatgcgttcgtgtatgtcttgggcggcaaagtagtaacgcagcattttggcggtgcgcgggtggcggtgtttgccgcgaaggcggtaaaacagggcggaacggcattggttgaaggcggtgatgacgccggtgttgctcatggcgaggtcgatgtggcggttgcctatccaggctgcctcatcggggtcgaagaagtcggctttggcttcgaggtagccgccgagtgcgtcgtaggcgttggcgacgctttcttggacggggcggtggggcaggacgatttggaacaggaggatggcggtgctgtacagtacggtgccgcataaaatcatgaaggggttggtcagccagtaggtttcgggggtgtaggtaagtgtggtgtaggtggcgacggcgagtgcaccgaaggcgaaggtgcggtatttgagcccgaccgcgcctaaaatggtgaagccgaaggtcatcagggtcatggcgaggatgaagggcagccctgtgccgagggtgctttgtgccgtgagcgaggagagggtgaacagggcgacggtggtgatgatgtttttcagccgtccggtcaggcggttgtccaaatcgacaaggccgccggcgatgatgccgagtacgaagggcatggcgagcttgggttcgcctagctgccagacgatggaggcggcggtaaaaacactggcgaaaacgggaagcgaggtaatgagcagaggcttgaggagtggggttttcatggttttaccggtttattgttatgaagtgaatatagtggattaacaaaaaccagtacggcgttgcctcgccttagctgaaagagaacgattctctaaggtgctcaagcaccaagtgaatcggttccgtactatttgtgctgtctgcggcttcgtcgccttgtcctgatttttgttaatccactataaatttaatccactataaagtgtagcacatgaatggggcggataaaatcatgccgtctgaaaacggggatgcggttttcagacggcattgggttttgcggatcaggaaatgaggttgagaccgttgaccctgtcgtaaaggagttcgggcgttttgccttctttgtgcagttggatgtgcaatcgcaggttgttggcggaaacggactggcgcagggcttcttcgtaactgatgatgccgtgacggtacagttcgaaaaggttttgatccatcgtctgcattccgtcggttttggcggtttccatgattttactgatgttcatcaggtcgcccttcaggatgaagtcttggatggcgggcgtgttgatgagcaagtcgacaaccgccgtcctgcccgttttgtcttgtttgagggcgaggcgttggcagatgatgccggtcaggttgagggcgatgtcgatcagtatttggttgtgctgttctttggggtagaagttgagtatgcgttcgagcgactgcggcgcggtgttggcgtggagcgtaaaaatgcacaggtggccggtttgggcgagctgcatcgcgtattccatactttccctgctgcggacttcgccgatgcagaccacgtcgggggattggcgcatagcgttttgtaccgccgtctgccagtttatggtgtcgacgccgatttcgcgctgggtaaagatgcagcggcgcggtttgtagataaattcaatcgggtcttcgatggtaacgatatggctgggcagggttttgttgcggtgttcgagcatagtcgccatcgtggtggatttgcccgaaccggtaggcccgacgataatcagcagcccgcgcggtgcgacggcgaggtctttgagtttttcgggcaggcccaattcctgcatttgcgggatgacgtggttgatgcgccgcaaaaccaaacctgcgctgccttggctgtggtaggcgttggcgcggtagcgcgtgccgctgcgcgactggacggagtagttgatttcgccgtcgcgccggaatatttccgattgttcggcgttcatcgtcgatgcggcgatggcggcggtttcctcgcccgtcagcgccttttgcggctgcggggttaatgcgctgttgattttcaacgagggcgggaatcctttgctgataaggatgtcggacgcgttttgtgcttctgcggtttcgcacaggcggtcgagcagcgggtggaagtgtgcgccgatttcggccggggtttcggatcggctttgttttttttgagaatacacttgaaccatttcgtccaagatgtcgtgcaggttatcggtattcatcgttagcttcttttcggtttaagccttgcagtttgcggcggcaggtttcaacaggaaggcggacgcttcttgttcggaaaggtagccgggcgggatgctgcgtcccgccccgcgtgtttgcgccttgttttcccgccggtatggccggaaagcggttgtgtgtcagaaactcatactttcgctgttttgcgcgcgtctgcgtgcgacttccggtgcgatcagcccttggcgcaccagcgattgcagcgattggtccattgtctgcataccgctcgcctgcccggtttgcaggacggagttaatctgcgtgattttgttttcgcggatgaggttgcggacggcggggttggcaatcaggatttcgtgcgaggcgacacggccgttgccgtcgtgcgttttcagcaggttttgggagatgacggcggtcagcgattcggacagcatagagcgcaccatttctttttctcccgccgggaatacgtccacaatacggtcgacggtttttgctgcgccggtcgtgtgcagcgtgccgaaaaccaagtgtccggtttcggcggcggtcagtgccaagccgatggtttctgggtcgcgcatctcgccgacaaggataacgtcggggtcttcgcgcaatgcggaacgcagcgcgttggcgaagctgagggtgtgctggtgcagctcgcgctggttaatcagggattttttgctttggtggacgaattcaatcgggtcttcgatggtcaggatgtgtgccggctgggtttcgttgatgtagttgatcatcgcggcaagcgtggtcgatttgcccgaaccggtagggccggtaaccaaaaccatgccgcgcggcgattctgcgattttttggaaaatgctcggggctttcaattcttccagcgataagacggtgctgggaatggtgcggaatacggcggcgggaccgcggccgatgttgaaggcgttgacgcggaatcgggcgacgttgggcagttcgaacgagaagtcgacttccaagttttgctggtagattttccgctggtggtcgttcatcaccgaagttaccatattaccgacctcttccgcgctcatttcgggaaggttgatgcgccgcatatcgccgtgaacccgaatcataggggatatgcccgaactcaggtgaaggtcggatgctttgtttttagcgccgaaggcgagtaagtcggtaatctgcataatgcggctctgtttagtataatgtttcgattggttggaatggttctaacaaccttgattgtaccgccctgactggaggggtttcaactgtttaatcatttttaattaggggataatctatgacggtgttgcaagaacgttattgtgaggtgtccgaccgtatcggaaaattggttctgcaggcgggcagggagccgcattccgtcagcctgattgccgtcggtaagactttcccttcagacggcatccgcgaagtttacgccgccggacagcgtgatttcggcgagaactatattcaggagtggtacggcaaaacggaagagttggcggatttgaccgacatcgtgtggcacgtcatcggcgatgtgcagtccaacaaaaccaagtttgtcgccgaacgcgcgcattgggtgcataccgtatgccgtctgaaaaccgccgtccggctgagcgggcaacgtccttcctcaatgccgcctttgcaggtgtgtatcgaggtgaacattgcgggcgaggcggtgaagcacggtgtcgcgcccgaagaagcagtcgcgcttgctgtggaagtggcgaagctgccgaatatcgtcgtacgtggactgatgtgtgttgccaaagccaacagcagtgaaacggagttgaaggtgcaatttcaaacgatgcggaaactgcttgccgacctcaatgcggctggcgttaaggcagacgtgctgtctatggggatgtcggacgatatgcctgccgccattgagtgcggtgcgacacacgtccgtatcggcagcgcgattttcgggaaaaggggctgatggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaaaaaattgggaatgaatttagtaaggtaattttgaatagggtagaaataatgaatgtttattttctcggcggcggcaatatggcggctgccgttgcgggcggattggtcaaacaaggcggttaccgcatctatatagccaatcggggtgcggaaaaacgcgaacgtttggaaaaagagttgggggtcgaaacttcggcaaccctgccggagcttcattccgacgatgttttaatccttgccgtcaaaccgcaggatatggaagctgcgtgcaaaaatatccgcaccaacggcgcattggtgctttctgtcgcagccggattgtcggtcggtacgctcagccgttacctcgggggaacacgccgcattgtccgggttatgccgaatacacccggaaaaatcgggctgggcgtatctggtatgtatgccgaagcggaagtatcggaaacagaccgcaggattgccgatcgaatcatgaaatcagtcggtttgactgtttggttggatgatgaggaaaaaatgcacggcattaccggcatcagcggcagcggaccggcttatgtgttttatctgctggacgcattgcaaaatgccgccatccgacaagggtttgatatggcagaagcacgcgcgctcagtctggcaacgtttaaaggagcggttgcccttgccgagcagacgggtgaagatttcgagaagcttcaaaaaaatgtaacgtcaaaaggcgggacaacccacgaagccgtggaagctttcaggcggcatcgtgtcgccgaagccataagcgagggcgtttgtgcctgtgtgcgccgttcgcaggaaatggaacggcaatatcaataatgtaaagaaaataaaaaaaccaatccaaaacgtgttatgatgcgcgttttcaaaaacgccttaggcaataagccttataaaaatcaaaggaataaagccactttgtggtgctttgttttttgcggtgaaccgagaggatatacattatggcaaagctgacagaacaagatattttgaattggagcgggccggaagacgattatatgaatgacgaccatttggcttttttccgcgaattgctggtaaaaatgcaagacgaactcatcgaaaatgcttccgctacgacagggcatctccaagaacacgaatcagcccccgatcctgccgaccgtgccacacaggaagaagagtacgcattggaactccgtacccgcgatcgggaacgaaaacttctcagtaaaatacaggcgaccatccgcaatattgatgaaggggattatggattctgtgccgatacgggagagcctatcggtttgaagcggctgctggcacgcccgacagccactttatctgttgagtcccaagaacgccgagagaggatgaaaaaacagtttgccgactgatggcggcaaacaaaatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgaacgcatcgatctttaacaaattggaaagccgaaatcaacaaacaaagacaaagcgtttgttttgattttttattctttgcaaaggataaaaatctctcgcaagagaaaagaaaacaaacacagtatttgggtgatgattgtatcgacttaatcctgaaacacaaaaggcaggattaagacacaacaaagcagtaagctttatcaaagtaggaaattcaagtctgatgttctagtcaacggaatgttaggcaaagtcaaagaagttcttgaaatgatagagtcaagtgaataagtgcatcaggtggatgccttggcgatgataggcgacgaaggacgtgtaagcctgcgaaaagcgcgggggagctggcaataaagcaatgatcccgcgatgtccgaatggggaaacccactgcattctgtgcagtatcctaagttgaatacatagacttagagaagcgaacccggagaactgaaccatctaagtacccggaggaaaagaaatcaaccgagattccgcaagtagtggcgagcgaacgcggaggagcctgtacgtaataactgtcgagatagaagaacaagctgggaagcttgaccatagtgggtgacagtcccgtattcgaaatctcaacagcggtactaagcgtacgaaaagtagggcggggcacgtgaaatcctgtctgaatatggggggaccatcctccaaggctaaatactcatcatcgaccgatagtgaaccagtaccgtgagggaaaggcgaaaagaaccccgggaggggagtgaaacagaacctgaaacctgatgcatacaaacagtgggagcgccctagtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagctgtggataggggtgaaaggctaaacaaactcggagatagctggttctccccgaaaactatttaggtagtgcctcgagcaagacactgatgggggtaaagcactgttatggctagggggttattgcaacttaccaacccatggcaaactaagaataccatcaagtggttcctcgggagacagacagcgggtgctaacgtccgttgtcaagagggaaacaacccagaccgccagctaaggtcccaaatgatagattaagtggtaaacgaagtgggaaggcccagacagccaggatgttggcttagaagcagccatcatttaaagaaagcgtaatagctcactggtcgagtcgtcctgcgcggaagatgtaacggggctcaaatctataaccgaagctgcggatgccggtttaccggcatggtaggggagcgttctgtaggctgatgaaggtgcattgtaaagtgtgctggaggtatcagaagtgcgaatgttgacatgagtagcgataaagcgggtgaaaagcccgctcgccgaaagcccaaggtttcctgcgcaacgttcatcggcgtagggtgagtcggcccctaaggcgaggcagaaatgcgtagtcgatgggaaacaggttaatattcctgtacttgattcaaatgcgatgtggggacggagaaggttaggttggcaagctgttggaatagcttgtttaagccggtaggtggaagacttaggcaaatccgggtcttcttaacaccgagaagtgacgacgagtgtctacggacacgaagcaaccgataccacgcttccaggaaaagccactaagcttcagtttgaatcgaaccgtaccgcaaaccgacacaggtgggcaggatgagaattctaaggcgcttgagagaactcaggagaaggaactcggcaaattgataccgtaacttcgggagaaggtatgccctctaaggttaaggacttgctccgtaagccccggagggtcgcagagaataggtggctgcgactgtttattaaaaacacagcactctgctaacacgaaagtggacgtatagggtgtgacgcctgcccggtgctggaaggttaattgaagatgtgagagcatcggatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtggttgtgaagatgcaatctacccgctgctagacggaaagaccccgtgaacctttactgtagctttgcattggactttgaagtcacttgtgtaggataggtgggaggcttagaagcagagacgccagtctctgtggagccgtccttgaaataccaccctggtgtctttgaggttctaacccagacccgtcatccgggtcggggaccgtgcatggtaggcagtttgactggggcggtctcctcccaaagcgtaacggaggagttcgaaggttacctaggtccggtcggaaatcggactgatagtgcaatggcaaaaggtagcttaactgcgagaccgacaagtcgagcaggtgcgaaagcaggacatagtgatccggtggttctgtatggaagggccatcgctcaacggataaaaggtactccggggataacaggctgattccgcccaagagttcatatcgacggcggagtttggcacctcgatgtcggctcatcacatcctggggctgtagtcggtcccaagggtatggctgttcgccatttaaagtggtacgtgagctgggtttaaaacgtcgtgagacagtttggtccctatctgcagtgggcgttggaagtttgacgggggctgctcctagtacgagaggaccggagtggacgaacctctggtgtaccggttgtaacgccagttgcatagccgggtagctaagttcggaagagataagcgctgaaagcatctaagcgcgaaactcgcctgaagatgagacttcccttgcggtttaaccgcactaaagagtcgttcgagaccaggacgttgataggtggggtgtggaagcgcggtaacgcgtgaagctaacccatactaattgctcgtgaggcttgactctatcatttgaagaacttcaagagataaaagcttactgactgattcagtcattaccgaatatattgattaaggctttaccgatttgtaacagtttaagtttggcggccatagcgagttggtcccacgccttcccatcccgaacaggaccgtgaaacgactcagcgccgatgatagtgtggttcttccatgcgaaagtaggtcactgccaaacacccattcagaaaacccccgattattcgggggtttttgctttgcccggaaaaaatgtttgctttgcccggaaaaaatgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccaggcataggccctgcggtgctggcgaagctgaaggatcaggcttccgtcggcgcgcccgcaccaaaaggcccagccaaaccagtgctgcccgcggataaaaaataaaatagggggaagtctgcagccgcatcaaatgccgtctgaacatgcgttcgggcggcgtttttataacaaaaacacttcatggcggttggttttatgcctatctaagtttttgtgtcgtgcatacctgaagatttcagacggcatcggtttatgctgtctgaaaagtgtattccgtttcagtttgtaagctatggcagtctgtttgtcttgtgttttgcgcaattgcccttattttgagccgtgattttattttgaattagatgaaaaaatgagtaatcaagatttttatgcgacgctgggtgtggcaagaacagctaccgatgatgagattaaaaaagcctaccggaaattggcgatgaaataccatcccgaccgcaatcctgacaataaagaggcggaagagaagtttaaagaagtacaaaaggcgtatgaaactttgtccgacaaggaaaagcgcgctatgtacgaccagtatggtcatgcggcgtttgaaggcggcggacaggggggcttcggagggtttggcggatttggcggtgcgcagggttttgactttggggatattttcagccaaatgtttggaggcggttcggggcgcgcccagcctgattatcagggtgaggacgttcaagtcggtatcgaaatcacgcttgaagaagccgcaaaaggtgtgaagaaacgcatcaatattccgacttatgaagcgtgtgatgtctgtaacggcagtggcgcgaaaccggggacatccccggaaacctgcccgacttgcaaaggttcgggtacggtgcacatccagcaggcgattttccgtatgcagcagacttgtccgacctgccacggtgcgggcaaacacattaaagaaccttgcgtcaaatgccgtggcgcggggcggaataaggcggtcaagacggtggaagtcaatattcccgccggtatcgatgacgggcagcgtatccgtttgagcggcgaaggcgggccgggtatgcacggtgcgcctgccggcgacttgtatgtaaccgtccgcattcgggcgcataagattttccaacgcgacggtctggacttgcattgcgaactgccgatcagttttgccacggctgctttgggcggggagttggaagtgccgaccttggacggaaaggtcaagctcaccgtccccaaagaaacccaaaccggcaggaggatgcgcgtgaagggtaagggtgtcaaatctttacgcagcagcgcgaccggcgatttgtactgccatattgttgtcgaaacgcctgtcaatttgaccgaccgtcaaaaagagcttttggaagaatttgagcggatttctaccggcttggaaaaccaaacaccgcgcaagaaatcgtttttagacaagctgcgcgatttgtttgattgattttaaggttcggaaacaagcagccgtatcggggaatctccttgatacggctgtttttatttgtttaaaaatagtttttattttcaatggggtatgaggcagggtgggataactgtttttaactgttctttttaaaacttgacatcatggcgtgatgccaacaatatgtgaacgtctgttgtcaaaggaagaataatgaataaatctttatccagttcggtagaagaataccgcgagctgacgctccgaggcatgatactcggtgcattgatcactgtaatttttactgcgtccaatgtttacctcggtttgaaagtcgggctgacctttgcctcgtcgattccggcggcggtgatttcgatggcggttttaaagtttttcaaaggcagcaatattttggaaaacaacatggtgcagacccaagcctcggctgcgggtacgctttcgaccatcatcttcgtcctgcccggtttgctgatggcgggctactggagcggtttcccgttctggcagacgacgcttttatgtattgccggcgggattttgggggtgattttcaccattcctctgcgttacgcaatggtggtgaaaagcgatttgccttatccggaaggtgtggcggctgctgaaattttgaaagtgggcggtcatgaagaaggggataaccgtcagggcggcagcggcatcaaagagctggcggccggcggtgcgttggcgggattgatgagcttttgcgccggaggtctgcgcgtgattgccgacagcgcgagttattggtttaaaagcggtacggcgattttccagctgccgatgggcttttcactggcattgttgggcgcgggctatttggtcggactgacgggcggtatcgccatcctgttgggcatttcgattgcttggggcattgccgtgccgtatttctcctcacacattccgcaaccttccgatatggaaatggcggcgtttgcgatgaagctgtggaaggagaaagtgcgttttatcggtgcggggactattggcattgcggcggtttggacgctgttgatgctgctcaagccgatggtggaaggcatgaagatgtcgttcaagagttttggcggcggtgcgcccgctgcggaacgcgccgaacaggatttgtcgcctaaggctatgattttttgggtgctggcgatgatgtttgttttaggcgtgtcgttttaccactttatcggcgattcgcacattacgggcggcatggcttggcttttggtggtcgtttgcacgcttttggcttccgtcatcggctttttggtcgccgccgcctgcggttatatggcaggtttggtcggctcgtcttccagcccgatttccggcgtgggcatcgtgtccgtcgtcgttatttcactggttttgctgctggtaggcgaatccggaggtttgttggcggatgaggctaaccgcaaatttttgctggcactgactttgttttgcggctcggcagtaatctgcgtggcttcgatttccaatgacaacctgcaagacttgaaaaccggctacctgctcaaagccacgccttggcggcagcaagtcgccctgattatcggctgtatcgttggtgcgctggttatttcgcccgtgttggaactgctttacgaagcctacggctttaccggcgcaatgccgcgcgaaggcatggacgcggcgcaggctttggcagcccctcaagcgactttgatgacgaccatcgcgtcgggcattttcgcccacaaccttgaatgggtctatatctttaccggtatcgtgattggagcagtattaatcgtcgtcgatttggtgttgaaaaaatcatcaggcggcaaacttgccctgcccgtccttgcggtcggtatgggtatttatctgccgccgtccgtcaatatgcccatcgtggcaggcgcggtgttggcggcggtgttgaaacacatcatcggtaaaaaagcggaaaaccgcgaaggccgtctgaaaaacgccgagcgcatcggaaccttgttctccgccggcctgattgtcggtgaaagcctgatcggtgtgattatggcgtttattattgccttctccgtgaccaacggcggctcggatgcgccgctcgcgttgaatctgcaaaactgggatgccgccgcttcttggctgggtttggcgttcttcgttaccgggatgtttttctttgcacagcgcgtactgaaggcgggcaagtaggctgtcggaaaaaatgccgtctgaaacgttcagacggcattttttatcggtaaagcggaaggcggagcttttcggcttgcgcccacgttttgccggcaaggtctttgggcgacagcagcggcgcggtttgaagcggccagcctatgccgactgtcgggtcgttccatattaaaacctgttcggcttcaggcttgtaatagtccgtgcatttatagacgaactcggcttcatcgctcagtacatagaagccgtgtgcgaaaccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttaaaccactcgtcgcggaaggtttccataaaaaagccgcgcgcgtcgccgaagacttggggctcaagcagttttacgtcaggaatggcggtatcaatgatgttcatctttttatctttcatctaaaggccgtctgaaaagtttcagacggcctcaaacattattttttcaacaggcgcagcaaatattggccgtattggtttttcgccatcgggcgcgccaattcttccagtttttcatcggaaagccaaccgttgcgccaagcgatttcttcgaggcaggcgatgtgcaggttttggatattttgcacggtttggacgaatgaagcggcttcgtgcaggctctcgtgggtgccggtgtccagccacgcgaaaccgcgtcccaatatttgaacggagagcgagccgtcttccaaatacatccggttgaggtcggtaatttccaattcgccgcgtgcggacggtttgagctgtttggcgaactcgacggcgcggttgtcgtagaaatacaagccggttaccgcccaatcggatttgggccgttgcggtttttcttcgatggaaacggcgcggaagttttcgttaaattcaaccacgccgaaacgttcggggtttttgacctgataagcaaacacggttgcgccgtgcgtttgcgctgccgcctgtttcaatgtttgcgtaaacgactgaccgtaaaaaatattgtcgcccaaaaccaagcaaacattgtcgttgccgataaattcttcgccgatgataaatgcctgtgccaagccgtccggactgggttgcacggcataactgatggaaatgccgaaatcgctgccgtcgccaagcaggcgtttgaaagaggcgttgtcttcaggcgcggtaatcaccaaaatatcgcggattcccgccagcatcaaaaccgacaaggggtaataaatcatcggtttgtcgtacacgggcaggagctgtttggatacgccgcgcgtgatggggtagaggcgcgtgccgctgccgcctgccagtatgatgcctttcatcttttctttcttcctttgcgatgggttttcagacggcattgcgtcgggatgccgtctgaaaactattttccagtacctaaacgttccaaacgatagctgccgttcaatacattttgccaccaggttttgttgtccagataccattgcacggttttgcggaggccggactcgaaggtttccaaaggcagccagcccaaatcccgcctgattttggctgcgtcgacggcgtagcgtacgtcatggccggggcggtcttgtacgaaagtaatcaaatcttcataacgcgccacaccggccggtttttcgggagcgagttcttccagcagggcgcagatggttttgacgacttcaatattggctttttcattgtggccgccgatattgtaggtttcgccgacaacaccttcggtaacaacctgatacagtgcgcgcgcgtggtcttcgacaaacagccagtcgcggatttgcataccgtcgccgtacacaggcagcggtttgccgtcaagcgcgttcagaatcatcaaaggaatgagtttttccggaaaatggtaaggaccgtagttgttggagcagttggttacaatggtcggcaagccgtaagtacgcaaccacgcgcggacgaggtggtcgctggacgctttagaggcagagtaggggctggacggcgcgtagggcgcggtttcggtaaacaaatcgtccgtgccgcctaaatcgccatagacttcatcggtggaaatatggtggaaacggaaggcttcgtgctgttcagacggcatttgttgccagtaggcgcgggctgcttcaagcagattgaatgtgccgacgatattggtttggataaactcgcctgccgaaccgatagagcggtcgacatggctttccgccgccaagtgcatcacggcatcaggccggtattgcgcgaatacgcggtcgagttcggcgcggtcgcaaatatccacttgttcaaaagcatagcgaggattatcggctacctcagtcaaagattccaaattgccggcataagtcagcttatcgacattgacgacagcgtcccgggtgtttcggataatatgacggacaacggcagaaccgataaagcccgcgccgccggtaacaaggatttttctcataaatttcagaggatagccaaaaaatataaacagattatagcagacagaatgtgtgtttttcagataaagaggccgtctgaaaacatctctttcagacggcctgtatcaggtcaacttaatcgtcgtagccattcggattattactcacccagcgccatgagtcttccatcatttgggttaaatcacgctgggtttgccagccgatttgcgcctttgtataggaagggtcggcatagaagcacgccaaatcaccggcacggcgcggtttgacttcatacggaatcgtcaaacccgaagctgcttcaaatgcgcggatgatttccaacaccgaagaagcgcggccggagcctaagttcagcaaatgcgtgcctgctacattactttttgcctgcatagccgcgacatggccttctgccaaatccatcacatgaatatagtcacgcatccccgtgccgtcgggggtagggtagtcatcgccaaataccgccaattgcggcagtttgcctgccgccacttggcagatataaggcaacaaattattcgggatgccgtttggctgctcgccaatcaagccgctttcatgcgcgccaatcggattgaaataacgcaacaaaatcatgctccagcgcggatcggctttttgaatgtcagtgagaatgcgctcaaccatcgatttcgatgcgccgtaagggctggtggtgtcgcccggtggcatatcctcggtataaggcactttgcccggatcgccataaaccgtcgccgaagaactgaacacaatgctaaacacgcccgcacgcgccatttcttccgccaacaccaagctgccggaaacattattatcataatatttcatcggctcggccacactttcacccaccgctttcaagccggcaaaatgaatcaccgaatcaatgcggttttccgcaaaaatacggcgcaaaatctcacgatcgcggatatcgccttgataaaacggaatctcttggccggtaatcgttttcaagcgtggcaggatattgatgctggaattgcataggttatccaaaatcacgacttgatggccgcttttcagcaaagaaacaacggtatgcgagccgataaaaccggtgccgccggtaacgagaatttttttcatagaataaaatactaaaaatactttgatagattgataataatggttgtaaaatcttaatgaaataattatccctgaagtagcagtagatttcttcagatttttttggttaagtatatttgatatctaaggtaaaatactataattttattcatatggtgtagaattaagggaaaatagtgaaaaaagtattactaattgccagttatgactcgttccttaactcgggctatgctgttgcaaaagagataaaagatgctcaaattgatatttatatccacaaaagtcgagaaaacattctttcaaatcgacagttattagaatcagggatagataaagaccaagcaattttttttttcatattgatgattactttattaagaatatgcatcaatattatgacgcagtaattttatcggttggaaatgggttgttaaaaaggttctttaagcagaatgcgcaattaaatattgcttcaaggccattgattattaccttgtttccaggtgtagtattcggtgatcaggcaagtattctatctcgtatgggggctgatattgttttatataataataagcatgattttagaattgcagaggaatataagaaacaatataaattaagttgtcaaaatatactttatggttatccaatttttcgccatgcttcgaaaggttgtcatggagagaaaatttactttattgaccaagttaaaatcccatttaaaaaagaagaaagaatttatacattaaaaaaattgattgccttggctgaaaaataccctgagaaagaatttactattttgctaagggttgcagataaagatattactgtgcatcaggataaacattcgtatatagagctggcaaagcagtttcagttgccgagtaatttgacaatagagcgaaaaagtaccgcgcaagccttccaagaaatggggtattgtttatcttattcatctactatgctttttgaagctgaatgtaagggtatccctgttggtgttgttgcagacttaggcttttctaaatcctatgcaaatcagcattttttaggtagtggggttttagtttattttgatcaaatagatttcacttccccaaaaatagcagatccggattggcttgattgctatgctactaaaaaggtgattacaactgatgagtttaataagctattaaagcaggttgtgccattgcaacatgattaccaagaatatttatctgcaggaattcgatatcaagctttggctaacacacacgccattccaaccaatagttttctcggcataaagccatgctctgacgcttaaatgcactaatgccttaaaaaaacattaaagtctaacacactagacttatttacttcgtaattaagtcgttaaaccgtgtgctctacgaccaaaagtataaaacctttaagaactttcttttttcttgtaaaaaaagaaactagataaatctctcatatcttttattcaataatcgcatcagattgcagtataaatttaacgatcactcatcatgttcatatttatcagagctcgtgctataattatactaattttataaggaggaaaaaataaagagggttataatgaacgagaaaaatataaaacacagtcaaaactttattacttcaaaacataatatagataaaataatgacaaatataagattaaatgaacatgataatatctttgaaatcggctcaggaaaagggcattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtacggatataatacgcaaaattgtttttgatagtatagctgatgagatttatttaatcgtggaatacgggtttgctaaaagattattaaatacaaaacgctcattggcattatttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcataaactgcatcccttaacttgtttttcgtgtacctattttttgtgaatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccaggcaaaaaaccggttatatttttttgcattaaatatttttttagcatattcaggaaaggggacatgcaatatgtcaaaatgatctatatatcctttaatattaagattatttccaatcaaataacgttctaattttgttggatgatatgaaaatgattctaataaaggagcatatgttccagtcccttcatcaattaaatgagtcgtaatattctttttttttgcaatactaatcagataggagtagtggcctgtaaaagacagcatatagagatgagcaggctgtataatattaaggatttttttgtaacttctataaatataaagtaattttttaggagttatattattagggcttctaggaagctcaaatagataaatagattcaaatagattcttgttagctgattgatgaactaacttaggcatttttaagtttttagaagtatataaaattactagtaaattattggttaatttttgtattttaattaggctttggacttggttaagctgacctaaattagatatgacaaataaattgttacgtgggggggtaagataaaatggagatgttgtcaaccacattgaatcttgaaaaaactttttaggctgaaaaagagctttttttattttctttagcattattgtatctcttaaaaattaatgagaattagctatatgtaatagccaatcctctgttaataaagtaactaagttaataagcattattcaatatcagtttttttgatttgagcacctttgcgaatattgcaagcagcgaccttaccaaataatgtttcatattcgttgacgctgaagtctccattgcctgggcgtttaacccataggttatctccggacaacagttctccttttttaatgtctttatctgctacgacagatgcaaaggcgaaatctttagttggcttttctcccgcgataatcgtgtcttttttgccgccgcgtgccaattttaaagcatgagcgccttgcttgagctctttaaaagtatccggattcatagagcatacaatatccggacctgggcgatccatgcggtcagtaaagtgacgctctaaaatcgaaccgcctaaagctactgctcctaagcaagcatagttatctaaggtatggtcagacaggccaatgattgcgtctggaaaggcttcagataaatcgttcataccacccaatcgaacatcttcgtaaggggttgggtagatgttggtacagtgaagcaaagcataaggtacccctgcttctcgaataatttctaccgactttttgatgctttcaatagaattcatgccggtagagagaataataggcttaccaaaagaggccaccagtttaattaatgggtagttattacattcgccagagccgattttatatgctggaatatccatacgttgtaatcgtaaagcagctgcacgagagaaaggagtactgataaaaatcatacccttactctctacgtattcttttaatttaatctcatcttcttcattcagggcgcaacgttccataatttcataaatagagacatctgcattgcctggaatgacttgtttggcctcatcagacatttcgtcttcaacgatgtgtgtttgatgtttaacaacttcagcgcctgcattataggcagcatcaaccatttcaaaagctgtttttaaagagccttcatgattgatgccgatttcacagataatcaatggttcgtggttgtaacctactgaacgattaccaattttaaattcgttgttgttttgcatttagctttccttgtgattaagaatgttttctgcctgttgtaaatcaagctcagtatcaatatcgatagagtcttgatgagacataatataaagtttggttggggcgataaaaaaacaattatttgcaattagtgaagcagtatcattaatgtaaattgcaccattaggcctaaatgcctgaggtaattgttggcgaggctgctccaaatcgcttagatggcgcatgggggcatattcgccattattgatttgaagcagggtttttagtggatgatgctccattgggcatgcagagacaacggatccttttattttctcatcaaatagagaaaaagcttcacgaatatgagcccctgtgcgtaatggactggttggttgtaatagggttactgtgccggaattactgccaattgtttctaaagcatgtattacacctgaaatagagctggctgtatcggaggccagctctgcagggcgtaggacgacttcgacaccgaaatttttagcttcttctgcaattaacccgccatcagtcgaaacaattatgcggtcaaaacactttgatgatatagcagcattaattgtatgaccaagtaatgatatgccattcattttccggagattttttaatggcaatcctttggagttttggcgcgcaagtataaccgcaatattttgtttttccataatttaaagattcaaatcgataaaacgtttttgagcagaaacattccacgtttcaggattgttgattacttcagcaaatctttctgtgctggtgcgagtatctccgccattaaaggtatcatctgcttcaaatttgcctaaactgcatgcttgttgaatcgcatcaaagatatttttagtttcataatctgtatgaataatagattttcccatatggcggttactttggcgtgtaccaacatcaattgaagggacaccgtagagaggagcttctctaatacctgcacttgagttgccgaccataaatttagcatgtttcaataagactaaaaaatattcaaatcgaatggaaggaaatgcaataaatttatcagattgatattttaataattcttgcagaatactttcagtgccagtgtcattattagggtagatgctaatgatattttggccacttaattctaatgctttgaaatattgggccgcatattgtggcattaaatgtgcttctgtagtcacggggtgaaacatagaaataccataattttcgtatggtaaaccgtaatattctttgacttcttctaaggatgggagggtggaagaggccataacatctaaatcgggggagccgatgatgtgaatatgctttcttttttctcccatttgcactaggcgagtgacagcttgttcatttgctaccaagtggatatgagaaagtttactaatagaatgacgaatggagtcatctactgtaccagatagttcaccaccttcgatatggcaaactaaacggctgcttaatgcacctacagctgcgcctgctagtgcttctaaacggtcgccgtgaatcatgaccatatcaggttcaatttcatcagatagacgagagataaacgtaatggtattgcctaaaacggcacccattggttcaccttggatttgatttgaaaacagatatgtatgttgatagttttctcgagttacttccttgtaggttctgccatatgttttcatcatatgcataccagttacaatcaaatgcaattcaaggtctgggtgattttcaatataggctaataaaggttttagcttgccgaagtcggctctggtacctgtaatgcaaagaattcttttcatgattttagaatctataagtatataagtataaggaagttggaaagaagaatactaattatactctacgtactcataaatttatttcgattaagtgctataattaggccatttataattatattaggatttggcttgtgtttaaagtgaaattttatattcgtcacgcagtattattattgtgtggaagtttaattgtaggatgctctgcgattccttcatcaggccccagcgcaaaaaaaattgtctctttagggcaacaatctgaagttcaaattcctgaagtggagctgattgatgtgaatcatacggttgctcagttattatataaggctcagataaatcagtcattcactcagtttggcgatggttatgcttcggctggtacgctaaatattggtgatgtattggatattatgatttgggaagcgccgccggcagtattgtttggtggtggcctttcttcgatgggctcgggtagtgcgcatcaaactaagttgccagagcagttggtcacggcacgtggtacggtttctgtgccgtttgttggcgatatttcggtggtcggtaaaacgcctggtcaggttcaggaaattattaaaggccgcctgaaaaaaatggccaatcagccacaagtgatggtgcgtttggtgcagaataatgcggcgaatgtgtcggtgattcgtgctgggaatagtgtgcgtatgccgctgacggcagccggtgagcgtgtgttggatgcggtggctgcggtaggtggttcaacggcaaatgtgcaggatacgaatgtgcagctgacacgtggcaatgtagtacgaactgttgccttggaagatttagttgcaaatccgcgacaaaatattttgctgcgtcgcggtgatgtggttaccatgattaccaatccctatacctttacgtctatgggtgcggtggggagaacacaagaaatcggtttttcagccagaggcttatcgctttctgaagccattggccgtatgggcggtttgcaagatcgccgttctgatgcgcgtggtgtgtttgtgttccgctatacgccattggtggaattgccggcagaacgtcaggataaatggattgctcaaggttatggcagtgaggcagagattccaacggtatatcgtgtgaatatggctgatgcgcattcgctattttctatgcagcgctttcctgtgaagaataaagatgtattgtatgtgtcgaatgcgccgttggctgaagtgcagaaatttttgtcgtttgtgttctcgccggttaccagtggcgcgaacagtattaataatttaactaattaatgtgagtaattaagatgtctgagcaacttcctgtggcagttgccactgaaaccaaagccgagcgtaaaaagccgaaaaagaaaagttggattaaaaagctaagccctttattttgggtaacggtgattatccctacggtaatttcgttggtgtatttcggcttcttcgcttccgatcgttttacgtcgcaatcgagctttgtggtgcgctcgcctaaaagccaatcttctctcaatggcctgggtgccattttgcagggcacaggttttgcccgtgcgcaagatgatatttacacggttggggagtatatgcgttcgcgctcgtctttggatgaactgcgtaaaatcttgccggtgcgtgagttttatgaaaccaaaggtgatgcgttcagccgctttaatgggtttgggttccgtggcgaggaagaggctttttatcaatactataaaaatcaggtgatgatcaattttgatacggtttcgggtatttccacgttgaatgtaacttcctttgatgcgctggaatctaagaaaatcaatgaggctttgttaaaacaaggtgaagcattgattaaccagttgaacgatcgtgcacgtgctgatacggtgcgctatgcggaagaagtagtgaaaacggcggcagagcgggtaaaggaagcctctcagaatctgacggattaccggattgccaatggcgtttttgatttgaaagcgcaatcggaagtgcaaatggggttggtttccaagctgcaagatgaattgattgtgattcaaacccagctggatcaggtgaaagcagtcactccggagaatccgcagattccgggtttgcaggcgcgtgagcagagcttgcgtaaagaaattgaccaacagttacgtgccatttcgggcggtgggcattcttcgttgtctaatcaggctgccgaatatcagcgtgtgtatttggaaaaccagttggcagagcagcagttggcagccgccatgacttctttggaaagtgccaaggttgaagcagaccgtcagcagctttatttggaagtgatctcgcaaccgagcctgccggatttggcacatgagcctaaacggttatacaacattgttgccactctgattatcggcttgatggtttatggtattttgagcctgttgactgccagcattcgtgagcataaaaactgatgaaagccttgcataaaacatcattttgggaatctttagccattcaaaggcgcgtaatcggtgcgctgttgatgcgggaaattatcacccgttacggtcgcaataatattggctttttatggctgtttgttgagccgttgctgatgacattcgttatcgtcttgatgtggaaatttttaagggcagaccgatattcaactttgaatattgtcgcatttgcgattactggctatccgatgttgatgatgtggcgtaatgcctcaaaacgggcagttgggtcgatttcttcaaatgccagcttgctttatcaccgcaatgtaagagttttggataccatcttggcgcgcatgattttggaaattgctggtgcaaccattgcgcagattgtgattatggcggtattgattgcgattggctggattgaaatgccggcagatatgttttatatgctgatggcttggcttttgatggctttttttgcgattggtttgggtttggtgatttgttcgattgcctttaatttcgagccgtttggcaagatttggggcacattgacttttgtgatgatgccgttatccggtgcgttcttttttgtgcataatttgccgcccaaggtacaagaatatgcattaatgattccgatggtgcatggcacagaaatgttccgtgccggatattttggcagcgatgtaattacctatgaaaatccttggtatatcgtattgtgcaatctggtgttgttgttgtttggcttggcgatggtcagtaaattcagtaaaggagtcgagccgcaatgatttcagttgaacacgtttccaaacgctatctgacccgccaaggttggcggacagtcttgcacgatattagcttcaaaatggagaagggcgagaaaatcggtattctcggccgcaacggtgcaggtaaatcgacgctcatccgtttgatcagtggcgttgagccgccgaccacgggtgaaatcaagcggacaatgagtatttcttggcctttggcattctccggtgcgtttcaaggcagtctgaccggtatggacaatttgcgtttcatctgccggatttacaatgtcgatatcgattatgtgaaagcgtttacggaagaattttcggagctggggcaatatttgtatgagccggtgaaacgctattcttcaggtatgaaagcgcgtttggcttttgcgctgtcgttggcggtggagtttgactgttacctgattgacgaagtgattgcagttggtgactcgcgttttgccgataaatgtaagtacgagttgtttgaaaagcgcaaagaccgttccatcatcttggtgtcgcacagccacagcgccatgaagcaatattgcgataatgcgatggtgctggaaaaagggcatatgtaccagtttgaagatatggacaaagcctacgaatattataattcgctgccttaaagcgattgtttttaaatcaggccgtctgaaatttcagacggcctgtccgttggaattctattgatgaacattactcaaattctttcccaagaactctccgcgactgccgcgcaaatcaccgccgccgtcgagcttttggacgacggcgcgaccgtgccgtttatcgcccgctaccgcaaggaagcgacgggcgggttggacgatacgcagttgcgccggcttgccgagcggctgcaatatctgcgcgagttggaagagcgcaaagccgttgttttaaaaagcattgaagagcaaggcaagctttcagacgacctcagggcgcaaatcgaagccgccgataacaaaaccgcgctggaagacctgtatctgccctacaaacccaaacgccgcaccaaagcgcaaatcgcgcgcgaacacggtttgcagccgctggcggacgtgttgcttgccgagcagtcgcaggacgtggaagccgccgcacaaggctacctgaacgaaaacgtccccgatgccaaagccgcgttggacggcgcgcgtgcgattctgatggagcagtttgccgaagacgcggaacttatcggcacgctgcgcgacaagctgtggaacgaagccgaaatccacgcgcaagtcgttgaaggcaaagaaaccgaaggcgaaaaattcagcgattatttcgaccaccgcgaacccgtccgcactatgcccagccaccgcgcgctggcggttttgcgcggccgcaacgaaggcgtgttgaacatcgcgctcaaataccagcccgacgacacgccgattacccggcaaagcgaatacgagcaaatcatcgcctgccgcttcaaggtttcagacggccacaaatggctgcgcgataccgtgcgtctgacttggcgcgcgaaaatctttttgtcgttggaacttgaagccctaggccgtctgaaagaagccgccgacaccgacgcgattaccgtgttcgcccgcaatctcaaagacttgctgctcgtcgcgcccgccggacggctgaccacgctgggtctcgaccccggctaccgcaacggcgtgaaatgcgccgtggtggacgacaccggcaagctgctggataccgtcatcgtctatttgcatcaagaaaacaatatgttggcaacgctgtcgcgcctgattaagcaacacggcgtgaagctcatcgccatcggcaacggcaccgccagccgcgaaaccgacaaaatcgcgggcgaactggtgcgcggaatgccggaaatggggctgcacaaaatcgtcgtgtccgaagccggcgcgtcgatttattccgcgtccgaactggcggcgcgcgagttccccgacttggacgtttccctgcgcggcgcggtgtccatcgcccgcaggctgcaagacccgcttgccgagttggtcaaaatcgaccctaaatccatcggcgtgggccagtatcagcacgatgtgaaccaaaaccagctcgccaaatcgctggacgcagtggtcgaagactgcgtgaacgccgtcggcgtggacgtgaataccgcctccgccccgctcttggcgcggatttccggcttgaatcaaacccttgcccaaaacatcgttgcctaccgcgatgaaaacggcgcgttcgacagccgcaaaaaattgctgaaagtaccgcgtttgggcgaaaaaaccttcgagcaggcggcaggctttttgcggattaacggcggtaaagagccgttggacgcgagcgccgtccaccccgaagcctatcccgtcgtcgccaaaatgctggcgcaacaaggcattagcgccgccgaactcatcggcaaccgcgagcgcgtgaagcaaatcaaagcgtccgacttcaccgacgaacgcttcggcctgccgaccattttggacatcctgtccgaactggaaaaacccggccgtgatccgcgcggcgagtttcagacggcatcgtttgccgaaggtatccacgaaatcagcgacttgcaagtcggtatgatactcgaaggcgtggtttccaacgtcgccaacttcggcgcgttcgtggacatcggcgtccatcaggacggcttggtgcacatctccgccctgtccaacaagttcgtccaagacccgcgcgaagtggtgaaagctggcgacgtggtgaaagtgaaagtgctggaagtcgatgctgcacgcaaacgcatcgcgctgaccatgcgcttggatgacgaaccgggcggcgcaaaacataaaatgccgtctgaaaaccgcagccgcgaacggacagccggccgcaaaccccaacgcaacgaccgcgccccagccaattcggcgatggcggatgcgtttgcgaagctgaagcggtaaaataatcgaagagtttatggattttgacttatgcacacaccacttacctatattgaccttttctcaggagcaggaggcctatccttgggttttgaacaagccggattccaacaattgctttctgttgaaatggagtctgattattgtcagacttaccgtaccaacttcccccatcatcaattactgcaaaaagatttaaccacactaaccgaacaagatttaatcaattgtcttaacggacaagcagttgatttgattattggaggaccaccttgtcaaggttttagtatggcaggaaagattggacggacatttacagatgacccacgcaaccatttatttaaagagtttgtccgaatagttaaaattgtccaaccatatttttttgttatggaaaatgtagcgcgactctatacacacaattcaggtaaaacacgtattgagattattcaagcatttcagaatatcggttattcggtggaatgtaagatactgagtgcagccgatttcggtgttcctcagatacgtagccgagtgatatttatcgggaggagggataaaggcaaaatttcctttcccgaacctttgcagatttcccatcagactgttggatcagcaataggacattttccaaaactggctgctggcgaaagcaatccacacgttgcaaatcatgaagctatgaatcattcggcacaaatgttagaaaaaatggcatttgttaaaaatggaggtaaccgtaacgatattcctgaaccattacgtccgaaaacaggtgatatccgtaaatacatccgttacaacagcaacaaaaccagccgtttgtattacaggagatatgcgcaaagtttttcactatgaacagaatcgggcgttaaccgttcgtgaattagctgccttacaatctttccctgataattttattttttgcggcagcaaaattgcccagcagcagcaggttggtaacgccgtaccgcctttattggcaaaagctattgctgaaagtattttaaaaatgagtgaaaatgaataagcaatatccgaaaattaactatatcggtaataaagagaaaatagcttcctggatttgtgaccagcttccgtctgatgtagatacagttgcagatgtatttagtggaggctgttcctttgcctacgaagccaaaaaacgcggctatcgtgtgattactaacgatattttggcaattaattaccaaattgctttagcattaatagaaaacaaccatgaaacattaaatgacgatgatgtcgcaatgattttttcaggcagcccgcatgccggttttatgagtcagcgttatgccgaaaaattctattttcacgatgaataccaacaacttgatttgtaacgtaaaaatatagggaaactggataaccagtataaacgcgctttggcgtttactttaatgcgtcgcgccatgatacgtaaaatgccctatacggaagatatgcgcccaggcgataccgctaatccttatggtgcgtccaaagcgatggtggaacggatgttaaccgacatccaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaagttgacctgatacaggccgtctgaaagagatgttttcagacggcctctttatctgaaaaacacacattctgtctgctataatctgtttatattttttggctatcctctgaaatttatgagaaaaatccttgttaccggcggcgcgggctttatcggttctgccgttgtccgtcatattatccgaaacacccgggacgctgtcgtcaatgtcgataagctgacttatgccggcaatttggaatctttgactgaggtagccgataatcctcgctatgcttttgaacaagtggatatttgcgaccgcgccgaactcgaccgcgtattcgcgcaataccggcctgatgccgtgatgcacttggcggcggaaagccatgtcgaccgctctatcggttcggcaggcgagtttatccaaaccaatatcgtcggcacattcaatctgcttgaagcagcccgcgcctactggcaacaaatgccgtctgaacagcacgaagccttccgtttccaccatatttccaccgatgaagtctatggcgatttaggcggcacggacgatttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagccaaaatcaggcgggatttgggctggctgcctttggaaaccttcgagtccggcctccgcaaaaccgtgcaatggtatctggacaacaaaacctggtggcaaaatgtattgaacggcagctatcgtttggaacgtttaggtactggaaaatagttttcagacggcatcccgacgcaatgccgtctgaaaacccatcgcaaaggaagaaagaaaagatgaaaggcatcatactggcaggcggcagcggcacgcgcctctaccccatcacgcgcggcgtatccaaacagctcctgcccgtgtacgacaaaccgatgatttattaccccttgtcggttttgatgctggcgggaatccgcgatattttggtgattaccgcgcctgaagacaacgcctctttcaaacgcctgcttggcgacggcagcgatttcggcatttccatcagttatgccgtgcaacccagtccggacggcttggcacaggcatttatcatcggcgaagaatttatcggcaacgacaatgtttgcttggttttgggcgacaatattttttacggtcagtcgtttacgcaaacattgaaacaggcggcagcgcaaacgcacggcgcaaccgtgtttgcttatcaggtcaaaaaccccgaacgtttcggcgtggttgaatttaacgaaaacttccgcgccgtttccatcgaagaaaaaccgcaacggcccaaatccgattgggcggtaaccggcttgtatttctacgacaaccgcgccgtcgagttcgccaaacagctcaaaccgtccgcacgcggcgaattggaaattaccgacctcaaccggatgtatttggaagacggctcgctctccgttcaaatattgggacgcggtttcgcgtggctggacaccggcacccacgagagcctgcacgaagccgcttcattcgtccaaaccgtgcaaaatatccaaaacctgcacatcgcctgcctcgaagaaatcgcttggcgcaacggttggctttccgatgaaaaactggaagaattggcgcgcccgatggcgaaaaaccaatacggccaatatttgctgcgcctgttgaaaaaataatgtttgaggccgtctgaaacttttcagacggcctttagatgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacagactattacaaccccaaagccgaacactcgctgatttggaatgatccgaccgtcggcatcgactggccgttgcaaggcgagccgaacctgtcgcctaaagacttggcaggcaaagtattgtctgaagcggtaacgttttaaaaataattcaggccgtctgaaagaatgttcctcttttcagacggcctacaatccattaataacaataatcgacgaaaacgcattgtgaaaaacgcctacatcccctctcgcggcatccgcaaaatcccccatctctccaccctattgcctgaatttcatatctgcaaagacgggaaagaagcagaggctgttgtcggctggggtttgcgcccgacgacacacaaagcgcgtgcttttgccgctgaacaccagcttccctttattgctttggaagacggctttttacgatcgctcggactgggtgtcgccggttatccgccctactctatcgtctatgacgacatcggcatctactacgacaccacacgtccttcgcgtttggaacaactgattcttgccgccgataccatgccgtctgaaaccttggctcaggcgcagcaggcgatggatttcatcctgcaacaccacctgtccaaatacaaccacgcgcccgaactttcagacgaccatcctttacgttccccatccaaacccgaaaccgtcctcatcatcgaccaaaccttcggcgatatggccatccaatatggcggcgcagacgcctctacgtttgaactgatgtttcagacggccttaaatgaaaacccgcaagccgatatctgggtaaaaacccatcccgatgttttgtgcggcaaaaaacaaggctatctgacccaactggcgcagcaacaccgcgtccatcttttggcagaagacatcaatccgatttctttgttgcaaaacgttgataaagtttattgcgttacctcgcaaatgggttttgaggcgcttttgtgcggcaaaccgctgaccactttcggcctgccgtggtatgccggatggggtgtaagcgacgaccgccatcctgaaatcaaccgccttgttcaaacccaacgccgcgccacccgcaacttgctgcagctcttcgccgcagcctatctgcaatacagccgctacctcaaccccaataccggcgaagcaggcagcctctttgatgtcatcgactatctggcgacggtcaaacgtaaaaacgacaaattgcgtggcgagttatattgcgtcggtatgtctttgtggaaacgcgcggttgccaaaccgttctttaacgtaccctcttgccgtctgaaatttatctcttccacccaaaaactggcaagggtcaaactgtccgacgatgcacgcatcctggcttggggcaacggcaaagaggccatcgtccgctttgccgaacaacaccacatccccctgctgcgcatggaagacggctttatccgctcggtcggactcggctccaacttagtgccgccgctgtcgctcgttaccgacgatatgagcatttatttcaatgccgaaaccccgtcccgtcttgaatacatcctacaaaaccaaaacttcgacgatcaagactttcagacggccttgaagctgcaaaaaatgctgaccgaaaaccacatcagtaaatacaacgtcggcagctcagacttcaccgccccgtcaaccgacaaaaccgtgatcctcgttcccggccaggttgaagatgatgcgtctatccgctacggttcgccccaaatctaccgcaatctggatttgctccgtaccgtacgcgaacgaaaccccaatgcctatatcatctacaaaccgcatcccgatgtagtcagcggtaaccgcatcggccatatttcccctgaagatgctgcacgatatgccgaccaaaccgccgaacaagccgacatcctgacctgtctccaatacgcagacgaaatacataccatgacttcgctgaccggttttgaagccttgttgcgcggcaaaaaagtcagctgctacggcctgcctttttacgcaggctgggggcttacccaagatctgctccccatcccgcgccgtagccgcagacttgagctttggcagctgattgccggcacgctcatccactatcccgactacatccaccccgaaacccatcaggccataaatgcagaaaccgcagcccaaatcctgatacgacaaaaaaatatgcaaaaaaacaacaacggattacatcgcgggtgctttgccaaaaaattaggtaaaatcaaacaactatatcgatctttcaaataaataccatcaaagttaacgatgcgtcataaacttgcctctattgcggcatcattgcctttgcatcgttaattctcttggcgtatgcttgaaagttcaacctaaaactattacataaaaaacaaaaccacattgcaacatgaaacagaccgtcctcaaaaataacctgcaaaacctgcttgaaagcgcagaaaatatcctgctgcttcaaggccctgtcggcgatttttttctgcgccttgccgactggctgactgcaaacggcaaaaccgtacataaattcaactttaatgcaggcgacgactatttttatccgcccactcaagcgcataccgttgtttttaacgacaactacgatgcctttcctgagtttttgcaagaatacatcactcaacatcacatccaggccgttgtctgctttggcgacacacgcccttatcacgtcattgcaaaacgcattgcaaacgaaaaccaagccagtttctgggcgtttgaagaaggctatttccgcccctactacatcaccttagaaaaagacggcgtcaacgcattttccccgttgccgcgccgtgccgacttttttcttgaacaattccctaagcttgcccagcaagaatataaagcgccaacgccggtacacggcggttttacgcccatggcaaaaaacgctatccgttactatatcgagttgttccgcaatccacgcaaataccccgactacatccaccaccgcgcacccaatgccggccattacctcaaaccgtggtcgctctccatcctcaagcgtttgaactactatattgaagacatccaaatcgccaaacgtgtggaagcaggcaaatacggcaagttttttattgttcccttacaggtattcaacgacagccaagtccgtatccattgcgactttcccagcgtccgcagcttcctgctccatgttttgagttcatttgccgagcacgcgcctgccgataccaacatcatcatcaagcatcatccgatggaccgcggttttatcgactactggcgcgacattaaacgctttatcaaagaacaccccgaactcaaaggccgtgtgatttatgtccatgatgtccccctgcccgttttcctgcgccacggtctcggcatggtcaccatcaacagcaccagcggcctgtccggactgattcacaatatgccagttaaggttctcggccgtgcctattatgatattcccggcattactgaccaaaataccttggcagaattttggaatcatccgacaccgcctgacaaagagctgttccatgcctaccgaatgtaccacctcaacgtgacccaaattaacggcaacttctacagtcaggtgtttttccccaacaaaaaaacctccaactcttccacaccagtaatctgacttagcgaaggaagttcaggccgtctgaaaacatttcagacggcctgaaacaatcaataccttagctactgccatgtaaataaaacacaaaaatctgcatttatcattaacaataaattacaaaaacagtataatgaccgagctgccatgagcgcataccgactcaacctgagccctttgtaacacacaaaatatggatatatccctaggcaaaacaatataacaagccaaacatcctaaagataagccggcaaggcaatacactctataaaactatgccgagcaaaatttttacaaagccctcaaccggtatcgccgcccatatgccgcagcatccgtcttccactttatatccgcccgcaaaccatgaccgccgctcctgatatcctctaccggcaagccgccgcccttttggaacaatccaataccgcccaagccctgcccctgttgcaacaggcggcagagcaaggttatgcggaagctgctttcgtattgggcaaccatctgctgcaaaacggccaaccggagcaggcactttcatggttggaagccgccgcggcccaacgccatcccaaagcactcttctccctgctgcaacaacgcgaacacaacggcaccccgaccggacagcttctcaacgactatgcctggctgggtgagcaggggcactcagaagcccaattaatcctcatgcgttaccacgcgcaacgcaacgatccacaatcgctctactgggcggaacttgctgccgcccgatatgccgcacctgcgtattaccatctggcacgccatcatcaacgccaaggcgacgttgaaacagccatcgaacaatacgaaaaagcggcagcactcggcgtaactgccgcctgctggcaacttggtcaaatctacttctacggtacaggtgtcagccccaaccacgcacaagccgaacactatctcgaaccagccgcacaagccggccacatcgccgcacaaacgctgctggctgaccttcttgccgcccaacgcaaacctgaagccttggaatggtatcgtcgtgccgccgataaggaacaagcggaagcacagtctaagctggcccaatacgccctgaccggcgaactttccgaacgcgatccgttccaagcggcacgatatgccaaagccgctgccgagaaaaaccatcctgaagccctgaaaatcatgggcgacctctaccgctacggtctcggtatcaaagccgacaaccatatcgcgcaagattactaccaccgtgccgccgcgctgggttctgccgccgcagcacaaaaactcatcagcgacgccgcgctgtaccatccgcaacaatacgaacaaatcaaaactgccgcctgcaacaacaacaaaccgaaaccatctaccgtttggcggaagcacaagcctgcgccatcggccgtcccgccgactacaatgccgcgcgaaaaaattacatggaagctgccgggttccaccataaaaacgcagcggcagccttaggccgcatctaccattacggcctcggtacggcgcaagatcctcgggcggctgcacactggtacgccattgctgccgaacaaaaccacccttccgcccaataccacctcgcctgtttttactatcacgggcaaggtgtcggctgtcatgttccgaccgcctgctactggctgcaggccgccatcggcaacggccacacttcggccgaatcattaatatccctattagaacaatggcgacgcgaagcacaccatgccatcggacaaaaggccgtctgaaaagatttacactcgcattttttgacaatctttaactattcccctaatatttgccagttatttttcacggacacgccattgttttcatttctttctgaaaacaccttgtccgcgcatcaataccatgacactcggcggataacgccaagcgttgaaacacactacatccggaacaaaaacggatgctcggaaaaatatttctaggaggtgaaacaacatggaatgggaattcaacagttattacacactgattgccgccacgctcgtgttgctggttggtaaatttctggttcaaaaaatcaaattcttacgagacttcaatattcccgagccggtagccggcggtttgattgccgctatcgtcctgttcgccctgcacgaggcgtacggcgtgagcttcaaatttgagaaaccgctgcaaaatgcgtttatgctgatttttttcacgtccatcggcttgagcgcggatttttcccgtttgaaggcgggcggtttgccgctggtggtttttaccgcgattgtgggcggatttatcttggtgcaaaactttgtcggggtcggactggctacggctttgggtttggatccgctcatcggtctgattaccggttcggtgtcgctgacgggcggacacggtacgtcaggtgcgtggggacctaattttgaaacgcaatacggcttggtcggcgcaaccggtttgggtattgcatcggctactttcgggctggtgttcggcggcctgatcggcgggccggttgcgcgccgcctgatcaacaaaatgggccgcaaaccggttgaaaacaaaaaacaggatcaggacgacaacgcggacgacgtgttcgagcaggcaaaacgcacccgcctgattacggcggaatctgccgttgaaacgcttgccatgtttgccgcgtgtttggcgtttgccgagattatggacggcttcgacaaagaatatctgttcgacctgcccaaattcgtgtggtgtctgtttggcggcgtggtcatccgcaacatcctcactgccgcattcaaggtcaatatgttcgaccgcgccatcgatgtgttcggcaatgcttcgctttcgcttttcttggcaatggcgttgctgaatttgaaactgtgggagctgaccggtttggcggggcctgtaaccgtgattcttgccgtacaaaccgtggtgatggttttgtacgcgacttttgttacctatgtctttatggggcgcgactatgatgcggcagtattggctgccggccattgcggtttcggcttgggtgcaacgccgacggcggtggcaaatatgcagtccgtcacgcatactttcggcgcgtcgcataaggcgtttttgattgtgcctatggtcggcgcgttcttcgtcgatttgattaatgccgcgattctcaccggttttgtgaatttctttaaaggctgattttccgcctttccgacaaagcacctgcaaggtttaccgcctgcaggtgcttttgctatgatagccgctatcggtctgcaccgtttggaaggaacatcatgtatcggaaactcattgcgctgccgtttgccctgctgcttgccgcttgcggcagggaagaaccgcccaaggcattggaatgcgccaaccccgccgtgttgcaaggcatacgcggcaatattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaagacggtcagacggcatttgtcgacaacacggtcggtatggcggcgcaaacgctgtctgccgcgctgctgccttacggcgtgaagagcatcgtgatgatagacggcaaggcggtgaaaaaagaagacgcggtcaggattttgagcggaaaagcccgtgaagaagaaccgtccaaacccacgcccgaagacattttggaacacaatgccgccggcggcgatgcgggcgtaccccaagccgcagaaggcgcgcccgaaccggaaatcctgcatcctgacgacggcgagcgtgccgataccgttaccgtatcacggggcgaagtggaagaggcgcgcgtacaaaaccagcgtgcggaatccgaaattaccaaactttggggaggactcgataccgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattaggggcaaaccgatgaataccgtcccaaaaagcaggattcccgtcaaaccgctgcccgaaaaaaccacagacgaagccaaagtcgaaaaatggcggcagctcggtgcggaacacggtttgtcgggcgaatgggcagttgccgtcagattgggcgaaaacggttttaccgaagaacagatggaaaatatcgccaacctgttcggcagataaagagaaaattgacggaaatgccgtctgaaaccctgttatcggtttcagacggcattttgaccaatacggtacgcaggcgcaaaacagccggcttttcctgtgttgcctatgctgatgtttcaacacacaggacgatacaaaaaacgtcgccctatgtgccgtcctgattcggaagggttacgctccttccaaatatagtggattaacaaaaaccggtacggcgttgtctcgccttagctcaaagagaacgattctctaaggtgctgaagcaccaagtgaatcggttccgtactatctgtactgtctgcggcttcgttgccttgtcctgatttttgttaatccactataaatcgagcctaaaacaatgccgtctgaaacggaaatctgtttcagacggcattgttacattcaaacggcgggccgtttatttgaatttgtaggtgtattgcagaccgatgatgtcggcgtggtttttgaaacgtgcggaagacgcgcctttgctgtccacatcgttgccgcttgccttcgccgtgcggtagctggtgtcgttgatgtggatgtgggtgtaggcggcatcgacgacgtggtttttaccgatatggtatttcataccggcggagaaccagatgcggttgccgtcgggtaggctgttcatgcggtagtcggcgttgcggacgggcgatttgtcaaaagcgatgccggcgcgcagttgcagcggttcgctgatttgataagaaccgccgaagccgactttgtaggtgttgcgccagttgggggtgatggtggtgcggtcggatttgcctttgacgacggttttttctttttcaaaaaccagttccgccttatcgaagcggctgtggcgcgtccaagttacgtcgccgaacaggtcggctttatcggacactttgtacataccgtgtacggacaaagactcaggcgtaacgattttaacgcgggctttttcattcgccgtgtagccgtttgctgcaagcatcgtactccacattgctttcgccgccgcgccgtctgccgcccattcggcatcgcctttgagcgtgtgcgagactttggaacggtagttcacgcccacgcgcgcacggtcgttgatgtcccacatccacgccagttggtagccgaagccccaatcgctgcctttgacatcggcgtgtccgtcggcctgaatttttgcagcttcggctacaccgttaggtttgggcggttttgccgtcaatatctctgctttactcttaatcccccagtcggcatatttgcgcagttcggcggaagtatgttgggcgatgatgcctgcgccgaaggaatggcggtcgttgagtttccacgcggcgacaggttcgacggcgatgctggtcagaccgagtttgttgatgttgtggcgcaacacggaatctttttcgtattcggtggcagagccgaaggggacgtacacgcccaagcccacggtcagattgtcgttgactttgtatgcgccgtagatgtggggcgcgaccgtggttttggtgattttgccgcttttcgaaccttggacgggaagcccggtaaagtcggtggcggaatccgcctcataatgaatgctgggcagcacgatgttggcgttgacggaaatctggctgctgtcgagtttggtcaggccggcagggttgtagaagatggtcgatgcgtcggcggcttctgcggcggcggcatttgccgtgctttgcgcgttgaccgactgtgtgccgaagtggtagccggatgcgtggacggatgcggcggcaaaggcagtgccgagcagcaggacggtttttttcagtgcggaaggggtcatttcggtttccgtaaaaaggcggacggtggataaatatagtggattaacaaaaatcaggacaaggcgacgaagccgcagacagtacagatagtacggcaaggcgaggcaacgctgtactggtttaaatttaatccactataaaaaaggcagtcggaaatgccttgtttcgctttagtataggtactcgattttatccgatgttgccggatttgcacaattttttcagagtttgcccgaaccgccgcgccgccgcaaaaaatgccgtctgaagcctcgggcatcggcttcagacggcattttccactcagggcggattatttgacgcgcagcacttccagtgtgttggtcgaaccggattcgcgcatttgcgaaccgctggtaatgatgtattggtcgccggaatgcaggatgttgtgttccaccagcatcgtttcgacttcgtttaacgccgtgtcgtggtcggtactggttgccaaaatcagcgggcgcacgccccggtacatcgccatacggcgttgggcggaaacgctcggggtcagcgcgaaaatcggcagggtgatgttgtggcggctgatttcaaaggcggtcgaaccgctttcggtcagggcgacgatggctttggcgtgaaccgcgcgcgccacgctgaccgcaccgccggcaaccgccaggttggtgctgaccgcttcgggatactcgacctgttcggcaacgccgttgagcgaatcctgctctttttccgcagccgcgcagataatcgccatttggctgacggtttcaaacggatacgcgccgacggcggtttcggcggaacacatcaccgcatcggtaccgtccaataccgcgtttgccacatcgctgacttccgcgcgggtcggtacggggttggtaatcatcgattccatcatttgcgtcgccgtaatgctgaagcggcgcaactcgcgggcgcggcggatcatccgtttttgcagggcggggacggcggcgtgtccgacttcgaccgccaagtcgccgcgcgcaaccataatgccgtcgccggcgaggatgatttcgtccaagttttcaatcgcttccacgcgttcgattttggaaaccaaaccggggcgcacggccgtgctgcccttcatttcttcttcgactttggcgcgcgcgatatgcaaatcttcggcggatttcacaaagctgatggcgaggtagtcgcaaccgatggcaatcgcggttttcaggtcgcggaagtctttttcggtcaacgcgcctgcggacagaccgccaccgcgtttgttgatgcccttgttgcttttcaggacgtggctgttttccacccttgtgataatcctgctgccttcgacggattccacggtcagggtcagcaggccgtcgtccagccacaagacatcgcctgcggcaacgtcgtcgggcaggtcgcggtagtccaaaccgaccgcctcgcgcgtgccttcgccttcgagcgcggcatccagtaccagcgtttcgcctttgttcaattcgatgccgccgccggcgattttgcccacgcggattttcgggccctgcaggtcggcaatgatggcgatttcctgtccggcgcgttttgccgcctcgcgcacgatgagggcgttttcctgatggaattcgggcgtgccgtggctgaagttgaagcggacgacgttcagaccgccgacgcggatcatgtcttccaacagttcgacgttgttgctgcccggcccaagggtggcgacgattttagtgttgtggctgatgcgggtcagatcgcggcttgtctggttcatatgaaagtccttttggtctcaatcgggtgttttgcggtattttgttacaaaattacagaaatttggaaccggtttgatgtccatttgatgaacgcggcggaatattctgtaaaaatatgatttaaattaatagtttgatattttacctgcaaaccgccttttttggcgcaaaattacacggttttatgacttaggctaaatttattttggggctgtcctagataactagggaaattcaaattaagttagaattatccctatgagaaaaagtcgtctaagccggtataaacaaaataaactcattgagctatttgtcgcaggtgtaactgcaagaacagcagcagagttagtaggcgttaataaaaataccgcagcctattattttcatcgtttacgatgacttaatttatcaaaacagcccacatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaaccaggcaaaacgtcatttacgcaagtctaacggcattcccaaagcgcattttgagctgtatttaaaggagtgcgaacgacgttttaacaacagtgagataaaagttcttgttccattttaaaacaattagtaaaatcgagtttatcttagttatctaggacagccccgtttgtgtactgaaatgcttcaaaacaccaaaccaagtttcgttttctaaaatacgaaaccattactgctgcctaaatttttttggattgctaaattatggcagtatgattttggattttaaattgaaaggcaagaaaaatgtcaaaaaatgatgtagttaaagtaattggtatattccccctattgtccgaacaatagagcagacttcccggcaggctgcccacatcagaacgcccgttcgctggtttgtacgtcctgaaaaagctcttgcattaagttaatcataatgggaaatttaaatttttttaatgcttacttaaacaaaagccccactccaccattaggagtttctttttcagtatacaagtaaatatttttaaaatattgatttaatttaaaataaaatacttgcaaaaaaagtattaaattaaacttaagaaaggttaattctgatttacatttccaaccatacttctttacaggagaaaatcatgaaagagttacacacctctgaattagttgaagtgtcaggtggcaaattccatatctttgcacagggtggcggcaacctaggtaaaaaagatatggttgctgttggtaaaattggtgcttcctattcccctaacaatagtggagtagagttttctgttagcaagcaatttggatatgtacaaggtcttggtgtacagttttcgaaacctacttttggtattagtaaaaaatggtaagattttttgttttatcctttctgacattaataaatctatgctcattaagcgcatgcaatagccactttacaggaaatatcaatccattaggtactcacaataaagttgctaatcccaattgtgccaatagtgccaatagtcatatcagacaacccagtaggaaaaactatgatccaactgaatatagtgcttggttacagtatatgcatgattgcaaataatgagtaacgatgaaaatttacttttttctcaaccacacttaacaaaggtgaatattatgcaagttttgactttgaatgaaatttaacaagtttctggtgctgcttgtaactggcgtgatttctcaaaaaataccattggtagtgcattaggtggagcagctggtggggcaattgttggttcatttgcaggtggtattggtgctattccaggtgcgaaattcggagctattggtggtgcaatcactggtgctgtacaatatggaagcacttgttggtggtaatattccttaataaaactagggtattttgatattttctattcaaaataccctagtttttcataagaacttaaatacaaaaaggaacaaataatgaaaaaatatagtgattattttaaatatttaatcttttttttgattttactcccaacaaattatctcgtatctcattatgtggtacaaacctcaatgagtatgttaagcattttaagttcttctataataacaacttgccttttttttgtttttacaaatttatcccaatcaaagaaacataaataagtacacatgtctaacaatcactcatttttcagaccagaagtctttgtagctcaacggaacaagtggacaggaccagtaggctgggttgacgcaatgggagctggtattttctctgttgctggcggatacaatatcggtcgtggcatgatgaagccataagataattacatcattaaggaaaaggtaatttcagttacagcaatatgtattgaagttacctttttctatttagattgaacaattttgaaagagaaaaattatgaatactgaaaccatttacgccactgtcttttgcattttagctgcaaccatttctggattattggttaaatttaatgtaattaaaatagaaacatcaatcaatagcaaatttatgttattaggcataagtattttaattattggtatttttctatccatttttttttaagaaataataataaatgtcccacttattccgaaaagaagtctttgtagcccaacaaaataagtggacaggtcaggttatcttgacccgtccattctcttttttatttctgactttttgcgcttttctcattgctctgtgtatcattatctttttgatttttggtagctataccaataaaacaaccgttgaaggtcaattacttccaactatgggggtggttcgtgtttactcttccgatatcggcacgattacgcataaatttgttgaagatggtaactttgtcaaagctggcgaaccattgttcaaactttccacatcgcgttttggcgaaaaaggaaacgtacaagccaaattggcagcagaagccaaccttaaaaaaactttggcattacaagaattggaacgtttaaagcgcattcatcaaaatgagcaaaaaaatgttcataacaacattcatcgtttaaacaatcaattagagaatattaaacagcaaattacagggcaaaatcgtcaaattcgtttagcggaaaaaacccttaacaagaacaagtttttagccagtcaaggcgcagtatcccaacaagataagatgaccgccgaaagccatttattggaacaacgctcacgtttggagagcctaaaacgtgaacaaaataatgcaatcagggaacttgatgaacagaaaatcacattaagcagcctgcctgaacgccataaaaccgaattgagccaactcaaccgtgcgattacggaaatgaaccaagaaattttggattttgatttgaaatccgaacaaaccatacgagctagtaaatcaggttgagacctttgcaaaaataatctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaggttatatatcaacaattaatgttgatatagggcaacaagttgaaccgtctaaattgctgttaagcattgtccctgaacaaactgaattggtcgccaatctttacatacccagtaaagctgttggttttattaaaccgaaagataaagttgttttacgttaccaagcgtacccttaccaaaaatttggacatgccacaggagaaattatttcagttgccagaactgctctcggtaaacaaaagctatcaggtttaggtatcattttcactaacccaaccttattaaatgaacctgcctatcttgtgaaagttaaattggaaaaacaaacgattaaagcatacggagaaaacaagccgcttcaaattggcatgattttagaagcagatattctccatgaacgaaaaaattgtacgaatgggtacttgacccactttacagcatttcaggaaaaatcaattaaaaatggattatttatcaagactgtcctttggatttaacaaaaagctacctgtcattctgcaaacagaagttgctgaatgtggtttagcatgcctgacatccatcttgtcctattatggctttcacactgatttaagaacgttacgccaaaaatacaccctgtcattaaagggcgcaaatcttgcagacatcatgagatttggcaatgaaatgaatttaacgccacgagctttgcgtttagagttagatgagctgtcaaatttacaactaccctgcattctccattggaacttaaaccattttgttgtactttgttccatttccaaagacagtatcgtcattatggaccctgctgtcggtatgcgaaaaatcaaaatggacgaagtttcacaaaaattcacagggattgccctagaattattccccaatacccattttgaagagaaaaaagaaacaaagaaaatcaaaatattatctctattaagggggggtcaggcttaaaacgctctttaattcaaatgcttatattagctatttctttggaagtctttgcattggttagtccattctttatgcaatgggtaatagaccatgtcattgtaactgctgataaaaatttattattgacccttactttgggatttggtttactgactatcctgcaacagttaattagcctgttacaagcatgggtaggtatgcacctatctacaactcttaatttacaatggaaagccaatatatttaaaaggttacttgacttacctaatgactatttcagtaaacgacatttaggagatgtgatttcaagatttggttcaatagatcatatccaagaaacactaacttctactttttttgttttagttttaaatagcttaatggctgtttttactttcgtgttaatgacaatttacagcactcaattatcgctgattgttcttttaacacttgttttgtacatactaattcgttggcttgcatattacccattaagaaatgcaacagaagaaaatattgttcatgaagccaaacaaaactcatatttcatggaaaccattcgtggtatccaatcagttaaattatttgataaacattatcaaagacatggcacttggatgagcctatttgtgaatacagtcaataccaagctgacaacagataaactctctgctttatttgaattttcaaataaactgttgtttagcatggaaaatgttatcataatttatcttggtgcaagcgcaattttagatggttcatttacagtcggtgttctgatggcttttttggcttataaagggcaatttgaaagcagaacagcttctctcgttgaccaatacatccaaatcaaaatgttagggcttcatgctgaacgtttggctgacattactttaaatgaaacagaaactgaaattattaagtataatcatatacctaaattagataatgaacaactggttcttaaagttgaaaacgtctcattcagatatgctgataatgagccatatctttttgaaaacattaatttggaatttaaagataatgaagcagttgttttaacaggacaatctggtcgggggaagtccactttgttaaacattttaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccaaatatggagctcattgaacaatgtgcaaaaatggcacaaatacatgacgatatacttaaaatgccaatgggctatgagaccttgattggcgatatgggaaatatcttatcaggtggacaaaagcagagagttatcttggctcgtgcattgtataaacgacccaaaattctatttttagacgaagcaagtagccatttagatgtagaaaatgaacaaaaaattaaccataacctaaaaagtcttggtattatgaaaataatggttgcacaccgccaagaaacaattcaatcggcagataaaattctgaatttaggttgaacagaacaagacttcatttttctttaacaaaaagtgaagtcttttttcaaataatttaatagaatacatgaaaatagcggtttaacgttccatttcccaatcatcacgactggctttgtgttttggcgatttttcagtttcctttttctgttgaatttgttgttttttctgctcttgttcccatttttgggctaatttcacggtctcattttcagcccattccatcacggcacaacgatgtagcttttctccgatatcgccattaaagccagctccacgaacttcaccataaattcttgaatatttttgattatattcaatttcttttccattttctttaaaggatttctcccacttttcacaaacttcatcaaaatctttcaaagggatattttttaaggggctgtcctagataactagggaaattcaaattaagttagaattatccctatgagaaaaagtcgtctaagccagtataaacaaaataaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcaagtttgtcctagttatctaggacagccccttgttttttgttcggcggcttgcgtggtcgggtaaaatgaaagttttgaacggttggtcggacaggaagatgtggcgggttttgagtgctttgccgataggcgtggtgttttttgatttgatctacggttttgtgttgaatgtgttgcagggtttggatttgcagcgtgccgtgccggattcggaaggcgtgttggcggttacgcccgatattgcattcaacagtttgcagattgtcgccaacggcggtatggcggcggtggtctgtttcgggttggcggttgtgtttttgctcaaccgttcggtgcggcggcggcaggtgttggaaatcggggtgttccggatgttggggctggtggcggtattggcgttcagcgcgccgtcggtgtgggagtgggcgaacgcgctgccgctgctgctgaagggcgcggacgtggtcaatacggggaatgcgcgttatgtgctgacggctttgtgtatgccctttccggcggtgtcgtgcgtcatcgggctggtggggcggttcaggcttcagacggcatcgggcagggcggcaaagtcagggggtgcgggcaaggcggacggataggacgcatttttcagcgggtgcgtcgagaagcagccgatgtgtttggcagccgcagcttggggggtgtagtgctaatggcggtttctttgcttttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatataaaataaatgggcaaaaatcggtttattatcgtttttgccgcatttggatttgttctaccgtaaaacgtgtttgacgaacgggattcttattaaaaaacatctgatttctaacaaaatcagtattttttggcacgatggctaaaatttttccttccatttcgccatcacgtgttttccatgcgctcaagaattgtgatttgctcattgagacgtgccccagcgatggatcagccagcaaaacagtttctccgttaataccgttcaataccgaaaaatggttgtttttacggtattttaaatacacaattacaggaatttttagttgtaccaactgttcaaatggcaaagcataaccttgtgcttcaaaacccagttcgggcattatgcgttgcatatcgtcaaaagaagcacgcatttgggttttatccattttgtctaagatttccgcttcagaataatgtctgccataaaaattattcagtaacgtggcaatcgaagccgcgccgcaagaaaaatccaaatcttgttttactatgccggaatctcgccgtgctttccaactccgtacatggatgttttggtaagaagcggggggtcaacaaacataggccaagcaaaaactatatttggggcgaaaccaatcaaagccgcataatttatcaatttataaagattttttatcataatatgtatacgcggaataaacgcatgaaacataaaaaaataaaatcatatgcaattttattgcatgaataaatatgaataaaatagataatgatgggagtaaatacgccatgtattttggaagtttaaatttattaataataaaataatttatcgtagcgcaaataaatcccaaaattggaacgattagaaaaaaaattaatacacccatcatcatgcaaactctatattaataaatagctaactaattctattgtggaaattagttagctaactaaaagttattaatgattattttcgagaattgactgcattgttggcagcattggcaccaaaacctagtgcatgaatacccggtctccatgccaaattcccagccaatccgcctccggcagcagcagccagccctgttttgccgctactcctgttgccgcaccgattcctgtcgcagtagccgcgccttgcgcagttcctaatttaccatgattatacaaattagcaccatgatacccccatgcacctaatgcaccgccaaaagcagcggctgcaataatgggaacaaattcaccttgtgtttctttcatttcagcctgtgataattgaattgctttcacattttggctgtcaaaaacttggctgtctaaattttgcgccattacaggtgtaatcatcatagccattacagttgcaattttcgttgcgctggtttgcacataaataggattagcaaattcgctttgattgcgttcagtgttgatgtagctaatactgctttctagtttgaatttacccttgtcagtcaataattcttccaaacttaaaggtaagtcagcataagcaatttggctggcaacagtcaaaataaaatctattagacatttgtgtttttgcatcatttcgtttgattttctaggttttgagaatgatacaaagttttttacaaagtaaagagtcactctgaaaaaacttttttcattataaatcaaaatattgatagaataaatagcgagcatcgattcacggtgcgctttagtgcaaagcgtacaacgcgagcctgaaccaccagccgcaacaggaaaagaaagccgatagagtgcaatgcttgccaacgtgcaagcgagcttgcaagaacgcttggctcaacgagagcaggcaagacagaaagcagaaagcaggataggagcggtaacgcaaaggtctcgggctttgatttcgccgtaaaccctgctgccgccttgtccggaaagggtgcaggcggcgagtgccgacagggtgcagatggggaggggggttttcatttggggtcgcaacggaagtggtatgcgcagatttcaaaaccgtttttgaaatacaggcggtgcgcgtcggcacggtcgtggttgacgtggacgttgaggtggattttggttacccctgtttccgcgccgattttgcggacttcttccaaaaggcgcgaggcgtagcctttgcggcggctttgcggcagggtaacgatgtcatcgatgtggatgtggcggccgctggcgagggtgcaggcttcgcggaagccgcagacggcgacggcattgtgtttgccttcttcaaaaatacccagcaggcggtagccttgggggcgttggactttgttgatctgttcggtaaagcggttgatgtcggtcagggcggaacgcaaaacgctcaaggctgcaaaggcggtggcggtgtcgtccgcgccgatttcgcgcaaaacgtaggatgcgcccgaggcggtctgttcctgtgctttctcggcggcgtgtttttcttcgattgcctgtgccagcatgacgtgttcgtcggcagggttgttttgtccgccctgttcgcgttcttcgagcagggctttgcagtcgatgacgcgcaggtcgttgtcggcggcaaagtccatcaggaagcggaacatttggggattgtcggtttccagttttttatcgacggcgacgcagcggatgttgtccaccagtatggggcgcacccatttcgaataggaaagcctgtggtctttggtgaacgaggacagaatgccgcacaggcgttccgcccagtcgctgggacggaaaatcttgccggaactcgttgtgccgtggatgacgacttcgtaggggttgcagactaacatggcggcttcctgaaaagaaatgtctagcgcgattataccttatgcttatgcgggcgtgtttggatatgccgtctgaaaagtacgggattcgtgcggtaaaactttgcggcggcaaatgtgcgataatacgcgccgtattgccgcttttgcgaagctgttccgcaaacatacgggcggcgtggacgacgtataaccggatacccgcctgacgcgggttttttacggaaggggggcaaaaatgcctaatccgctttacagacagcatatcatctccatttcggatttgtcgcgcgaacagttggaatgcctgcttcagacggcattgaagctgaaggcgcatccgcgcggcgacctgttggaaggcaaacttatcggttcgtgctttttcgagccgtccacgcgcacgaggctgtcgtttgaaacggcggtgcagcgtttgggcggcaaggtcatcggtttctcggacggcgcgaataccagtgccaaaaaaggcgagacgcttgccgataccgcccgcatcatttccggatatactgatgctatcatccaacgccaccccaaagacggcgcggcgcgcgtggcagcggagttttcgcgcgtccccgttatcaacgccggcgacggcacgaaccagcaccccagtcagacgctgctcgacctggttaccatttatgaaacacagggacgtttggacaagctcaaaatcgccatggcgggcgacttgaaatacggacgtaccgtgcattcgctttgtcaggcgttgaaacgctggaattgtgaatttgcctttgtttcgccgcccagcctagccatgcccgactatattaccgaagagttggacgaagccggctgccgataccgtatcctcggtagtttggaagaagcggcggaatgggcggatatcctgtatatgacccgcgtccagcgcgaacgtttcgacgaacaggaatttgccaaaatccaaggcaaattcaacctcgaagcgtctatgctcgcccgcgccaaaccgaacctgcgcgtgctgcaccccctgccgcgcgtggacgaaatccatcccgatgtcgatgccacgccgcacgcctattatttcgagcaggcgaccaacggcgtttatgcgcgtatggcgatattgtcgctggtgttgaacgaagaagtgtgaggaaccgatatggaaaccccgaaactcagtgtcgaagccattgaaaaaggtacggttatcgaccatattcccgccggcagggggctgaccatcctgcgccagttcaaacttttgcactacggcaacgcggtaaccgtgggcttcaacctgcccagcaaaacccaaggcagcaaagacatcatcaaaatcaaaggcgtgtgcttggacgacaaagccgccgaccgcctcgccctgttcgcccccgaagcggtggtcaacaccatcgacaatttcaaggtcgtgcagaagcggcatttgaacctgcccgacgaaatcgccgaagtgttccgctgtccgaacacgaattgcgccggccacggcgagccggtcaaaagccggttttatgttaaaaagcacaacgggcagacgcggctgaaatgccactactgcgaaaaaacctacagccgggattcggtggcggaagcctgacggattcccttaaaccgagtgggcggcatttcgtctgccgcctgttttgccaatctgaaatggaatgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcctgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcactcaatcaggcgttgcaggagatttcaaaaacatcggaaaagtccaaacggatattttattgaagatggaaaaatgccgtctgaaacggaaggtgtttcagacggcatttttgtcggatgattaattattcggagcggttgaagccaaacttcacgcggctgcggccctgatccggtatattgtccaaatcgcgtcccggattggcggcggtgtcgcctacggaaatatcggagatgttttccaaaatgatggcggacgacaggtgttcggaggtgcggtaaaccattgccaagcccacttcttcggcaggagtggaaatcagctcgacggtatccctgcttttgaaattgttggagaggtcgacctgcatcgttttcttgcgtttgtagaggctcaaaaccgtgcctttgtccaaaccgtccgcctcgcctttgtcgatggtgatggtttgaaactggccggcaatccttgtgccttcaaacacggaaacgattttagcctgaaccgggcgggacggttcgtgcggcatcatgttgaagcggtcggtgtcttccggcattttcatcaggtagtcgccctgctgtatttcggaaatggcggtttcgaccaccagcggctgtatcgaaggggtgcgcagcggggtaatcaaaggatgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagagcaggcgcggcgcggcagcggtttctttgcgggaaacgatttgcggatgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccggataaatcaggtcgggattgtggatttgatcccggttcgcgtcccacaggcggccccattgccacgggctgtacaggtatttgcccgaaatgccccacagggtgtcgccctgtttgaccgtgtagcgttccggcgcgttcgggcgcacctccaaatttgccgccaaagtttgtgttgagaatgccatacctgccgcgcagagcagggttataatacgacgttgcataaccgttccccttatctgataaatttcggtttgtcttgcttgattgggttggaaaaagcggcggcagcccctcgggatgtgccgcgtgataaaaaatgttccgcattttaacatcgaattatccgcaccatcacggtaattatgaaaaacaggcggcgtatccgccgaaggaaagagaaaattatggctttattgaatatcttgcaatatcccgacgagcgtctgcacacggtggcaaagcctgtcgaacaagtcgacgagcgcatccggaagctgattgccgatatgtttgaaacgatgtacgaatcgcgcggcatcgggctggcggcgacgcaggtcgatgtgcacgagcgcgtggtcgtgatggatttgaccgaagaccgcagcgaaccgcgcgtgttcatcaaccccgtcatcgttgaaaaagacggcgaaaccacttacgaagagggctgcctgtccgtgccgggcatttacgacaccgtaacccgcgccgaacgcgtcaaggtcgaggctttgaacgaaaaaggcgaaaagttcacgctggaggcggacggcttgttggcgatttgcgtgcagcacgagttggaccacctgatgggcatcgtgtttgtcgaacgcctttcccaactcaagcaggggcggattaagaccaagctgaaaaaacgtcagaaacatacgatttgacccttttgccgtgccgtctgaacgctgcaaagttttcagacggcacggtcttgtccgacaattttacgcacgcgcaggaacacgctatgaaagtcatcttcgccggcacgcccgattttgccgccgccgccttaagagccgttgccgccgccggttttgaaattccgctggtgctgacccagcccgaccgtccgaaagggcgcggtatgcaactgactgccccgcccgtcaaacaagccgcgctggaactcggtttgcgcgtcgaacagcccgaaaagctgcgcaacaacgccgaagccctgcaaatgctcaaagaggtcgaggcagacgtaatggtggttgccgcctacggtttgattctgccgcaggaagtgttggatacgccgaaacacggctgcctcaacatccacgcttcgctgttaccccgttggcgtggcgcggcgccgattcaacgcgcgattgaagccggcgatgccgagacaggcgtgtgtattatgcagatggacatcggtttggacaccggcgatgtggtcagcgaacaccgctacgccatccaaccgaccgataccgccaacgaagtccacgacgcgctgatggaaatcggtgcggcggcggttgttgccgatttgcaacagcttcaaagcaaaggccgtctgaacgcggtcaaacagcccgaagaaggtgttacttacgcgcaaaaattgagcaaagaagaggcgcgtatcgattggagcaaaagcgcggcggttatcgaacgcaaaatccgcgccttcaaccccgtgcctgccgcgtgggttgagtatcagggcaagccgatgaaaatccggcgggcggaagtggtggcgcaacaaggcgcggcaggcgaagtgttgtcctgttcggcggacggtttggtcgttgcctgcggcgaaaacgcgctgaagattaccgaattgcagcctgccggcggcaggcggatgaatatcgcggcgtttgcagcaggacggcatatcgaagcaggggcgaagctgtaaatcccttcagacggcattccgatccgcaaacgggaatgccgtctgaaaccatcagtcgaagaaagcgaatcacataatatgagtatggcacttgcccaaaaacttgccgccgacagcattgcggcggttgccgaaggacgtaaccttcaggacgtgttggcgcaaatccgcaccgcgcatcccgaccttatggcgcaggaaaacggcgcgttgcaggacatcgcctacggctgccagcgttatttgggcagtttgaaacatatgctcgcgcagatgctgaaaaagccgattggcaatccgcagctcgaaagcctgcttttggcggcgttgtaccagctgcattacacgcgcaacgcgccccacgccgtggtcaatgaggcggtggaaagcatcgcgaaaatcggacgcgggcagtaccgttcgtttgccaacgcggttttgcgccgctttttgcgcgaacgcgacaagcttgtggcttcctgtaaaaaagacgatgtagcgaaacacaacctgccgctgtggtgggtggcttacttgaaaaaccattatccgaaacactggcacaacatcgccgccgcgctgcaatcccatccgccgatgactttgcgcgtcaaccgccgacacggcaatgccgaaagctatttggaaaaactggtggcggaaggtatcgcggctaaggcgttggacgaatatgcggttacgttggaagaagccgtgccggtgaaccgcctgcctggtttttcagacggcattgtttcggtacaggacttcggcgcgcagcaggcggcgtatttgttaaacccgaaagacggcgaacggattttggacgcgtgcgccgcgccgggcggcaagacggggcatatcttggaactggcggattgccgtgttaccgccttggacattgatgcaggccgtctgaaacgggtggaagacaatatcgcgcgtctgggctttcagacggcatcgacggcgtgtgccgatgcacaggacctgtcggcatggtatgatgggaaaccgtttgatgccgtccttgccgacgtgccgtgtaccgcctcgggcgtggcgcggcgcaatcccgacgtgaaatggctacgccgtccgaccgacgcgctcaaaaccgcccgccagcaggaagccctgctagatgcattgtggcaggtgctgaaaagcgggggaaggatgttgatcgctacctgttccgtgttcgtcgaggaaaacgacggacaattgcaaaaattcctcaaccgccatgccgatgcagaactgatcgaatcgcgggtactcttaccgaacaaacaccaagatggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaccgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataatgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggctggcgtggaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggagcttgccggcgaaccgctgacggtggcggcggatacgaccgccatgcggcaggtgctgcacaatattttcaaaaatgccgccgaagcggcggaagaagccgatgtgcccgaagtcagggtaaaatcggaaacagggcaggacggtcggattgtcctgacggtttgcgacaacggcaaagggttcggcagggaaatgctgcacaacgccttcgagccgtatgtaacggacaaaccggcgggaacgggattgggtctgcctgtggtgaaaaaaatcattgaagaacacggcggccgcatcagcctgagcaatcaggatgcgggtggcgcgtgtgtcagaatcatcttgccaaaaacggtaaaaacttatgcgtagcagcgatattttaattgtagacgacgaaatcggcatccgcgacctgctgtcggaaatcctgcaggacgaaggttattcggtcgcattggcggaaaacgccgaagaggcgcgcaagctgcgccatcaggcgcgccccgcgatggtgctgctggatatttggatgcctgattgcgacggcatcacccttttgaaggagtgggcgaaaaacgggcagctcaatatgccggtggtgatgatgagcgggcatgccagcatcgataccgccgtggaagccaccaaaatcggcgcgatcgattttttggaaaaaccgatttccctgcaaaagctgctgtctgccgtcgaaaacgcgttgaagtacggtgcggcgcaaaccgaaacggggcctgtattcgacaagctgggcaacagtgcggcgattcaggaaatgaaccgtgaggtaggggctgcggtgaaatgtgcctctcccgtacttttgacgggcgaggcgggttcgccgtttgaaacggtggcacgctatttccataaaaacggtacgccgtgggtcagcccggcaagggtcgaatatctgatcgatatgccgatggaactgttgcagaaggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagacggcattgcctgcgaggaaaagctggcggaactgctgtcggaatcggtcgtccgtattccgccgctgcgtatgcagcatgaagacattcccttcctgatacaggggattgcctgcaatgtggcggaaagccaaaagattgcgcctgcctcattcagtgaagaggcacttgccgcattgacccgttacgactggccgggaaatttcgaccaactgcaaagcgtcgttgcaacgctgttgttggaggcggacggacaggaaatcggcgcaggggcggtttcttcccttttggggcagaatgtgcctgccgagggggcggaagatatggtgggcgggtttaatttcaacctgcccctgcgcgaattgagggaggaggtggagcggcgttatttcgagtaccacatcgcccaagaaggtcagaatatgagccaagtggcgcagaaagttggtttggaacgcacgcacctttaccgcaaactcaaacagctcggcatcggcgtttcgcgccgggcgggggaaaaaaccgaagaataggcccggacggccggtttaccggctgcgggcttttgttttcagacggcatttggtgcaaatgccgtctgaaatcgtaaggggacggattttatgacagaggacgaacgtttcgcgtggctgcaattggcgtttacgccctatatcggcgcggaaagtttcctgctgctgatgcgccgtttcggcagcgcgcaaaatgccctgtccgcaccggcggaacaggtggcggcactgatacggcacaaacaggcgcttgaggcttggcgcaatgcggaaaaacgcgctctggcgcggcaggcggcagaagcggcattggaatgggaaatgcgggacggatgccgcctgatgctgcttcaggatgaagattttcccgaaatgctgacgcaggggctgaccgcgccaccggttttgtttttgcgcggcaacgtgcaactgctgcacaaaccttccgccgccatcgtcggcagccgtcatgccacgccgcaggcgatgcggattgccaaagatttcggcaagtcgttgggtgggaaaggcattcccgttgtgtcgggtatggcttcgggcatcgataccgccgcccatcagggtgcgttgcaggcagaaggcggcaccatcgccgtgtgggggacgggcatagaccgcatttatccgccggtcaacaaaaaccttgcctatgaaatcgccgaaaaaggattgattgtcagcgagttccccatcggcacgcggccgtatgccggcaattttccgcgccgcaaccgcctgattgccgccctgtcgcaagtaacgctggtggttgaagccgcgttggaatccggttcgctgattactgccagattggcggcggagatggggcgcgaagtgatggcggtacccggctcgatagacaatccacacagtaaaggctgccacaaactgattaaagacggcgcaaaattggtggaatgcctggacgacatcctgaacgaatgcccggggctattgcaaaatacgggtgcttcatcatattctataaataagggaatacctgaaaagcgcatcactgccgttcagacggcatccgaccagctgtctctgcctgaaggcaaaatgccgtctgaaaagacggagaaccgacccgtcggcggcagtatcttggacaggatgggtttcgacccagttcatcccgacgtgcttgccggacagttggctatgcctgccgcagatttgtatgccgcactgttggaattggaattggacggcagcgttgccgcaatgcccggcggcagataccagcgtatccgaacttgaacgcactttatattaaggaacacgaatgaccgaagtcatcgcctacctcatcgaacatttccaagatttcgatacctgcccgccgcccgaagacttgggtatgctgcttgaagaagcgggtttcgatacgatggaaatcggcaacaccctgatgatgatggaagtattgctcaacagctccgaattttccgccgaacccgccgacagcggcgcattgcgcgtgtacagcaaagaagaaaccgacaacctgccgcaggaagtgatggggctgatgcagtatctgattgaagaaaaagccgtcagctgcgaacagcgggaaatcatcatccacgcgctcatgcacattccgggcgacgaaattaccgtagataccgccaaagtgctgaccctgctgcttttatgggcaaacaagagcgagctgcccgtgttggtcggcgacgagctgatgagcgcgcttttactcgacaacaaacccacgatgaactgaagcggcttcagacggcccgcccgagtccgtctgaaacgtcggcatcaaaaccaccatccagagaacgacaaatggcgaaaaacctattaatcgtcgaatccccgtccaaagccaaaaccctgaaaaaatatttgggcggcgattttgaaatccttgcatcctacggacacgtccgcgacctcgtccccaaaagcggcgcggtcgatcccgacaacggctttgcgatgaaataccaactcatcagccgcaacggcaaacacgtcgatgccatcgtcgccggtgccaaagaagctgaaaacatctacctcgccaccgacccggatagggaaggcgaagccatttcctggcatcttttggaaatcctcaaatccaaacgcggcttgaaaaacatcaagccgcagcgtgtcgtgttccacgaaatcaccaaaaacgccgtgctcgatgccgttgcccatccgcgcgaaatcgaaatggacttggtcgatgcgcaacaagcccgtcgcgctttggactatttggtcggtttcaacctttcgccattgttgtggaaaaaaatccgtcgcggtttgagcgcgggccgtgtacaaagccccgcactgcgtttgatttgcgaacgcgaaaacgaaatccgcgcgtttgaagcgcaggaatattggacggtacatctagacagccacaaaggccgcagcaagttcaccgccaaactcgcccaatacaacggcgcgaaactcgaacaattcgacctgccgaacgaagccgctcaagccgatgtgttgaaagaactcgaaggcaaagaggccgtcgttaccgccatcgaaaagaaaaagcgcagccgcaaccccgccgcgccgtttaccacatccaccatgcagcaggatgctgtgcgcaaactcggcttcaccaccgaccgcaccatgcgtaccgcccagcagctttacgaaggtattgacgtagggcagggtgccatcggtctgattacctatatgcgtaccgacagcgtgaacttggcggatgaagccttaaccgaaatccgccattacattgaaaacaaaatcggcaaagaatatctgccgagtgccgccaaacaatacaaaaccaaatccaaaaacgcccaagaagcgcacgaagccatccgcccgacttccgtgtaccgcacgcccgaaagcgtcaaacccttcctgagcgccgaccagttcaaactctatcaaatgatttggcagcgtaccgtcgcctgtcagatgacgcccgccaaattcgaccaaaccaccgtcgatattaccgtcggcaaaggcgtattccgcgtaaccggacaagtgcaaaccttcgcaggcttcctcagcgtttacgaagaaagcagcgacgatgaagaaggcgaagacagcaaaaaactgcccgaaatgagcgaaggcgacaaattgcccgtggacaaactctacggcgaacaacactttaccactccgccgccacgctacaacgaagccacgctggttaaagccctcgaagaatacggcatcggccgcccctcgacctacgccagcatcatctccacgctcaaagaccgcgaatacgttacccttgagcaaaaacgctttatgcccaccgacacaggcgacatcgtcaataaattcctgaccgaacacttcgcccaatacgtcgattaccacttcactgccaaactcgaagaccagcttgacgaaattgccgacggcaaacgccaatggattcccttgatggacaaattctggaaaccgttcatcaaacaagtggaagaaaaagaaggcatcgaacgcgccaaatttaccacgcaggaacttgatgaaacctgcccgaaatgcggcgaacacaaactgcaaatcaaattcggcaaaatgggtcgttttgttgcgtgtgccggttatcccgagtgcagctacacgcgcaatgtcaacgaaaccgccgaagaagctgccgaacgcatcgccaaagccgaagccgaacaggccgaactcgacggacgcgagtgcccgaaatgtggcggtcgcctagtgtacaaatacagccgcaccggcagcaaattcatcggctgcgtcaactatccgaaatgcaaacacgtcgagccgctggaaaaaccgaaagataccggcgtccagtgtccgcaatgcaaaaaaggcaacctcgtcgagcgcaaatcccgctacggcaaactgttttacagttgcagcacctatcccgactgcaactacgccacttggaacccgcccgttgccgaagaatgcctgaactgccattggccggtcttgaccatcaaaaccactaaacgctggggtgtagaaaaagtctgcccacaaaaagaatgcggctggaaagaacagattgaaccgcccgcgccgaaggagtaagattaggttggtttgaaagagaaaaggtcgtctgaaaaattttcagacgacctttgcttttctgtgattggtttatttgaatccgcgtgttgttttaaagtccgataaaatccggttcatttcaggcgcaaacaaggcgatgtaatcgtaagatagaccgcgactggcactgggatggggaaagcagacgacttcgcaatcttcaaacgattggaatttgacattgaaacgtgtaccgtcaaattctttttgcaccgtctccagcggtttggtctgcttaccgaccaactgctcgaagcgtggcagtacattttggttgttcagaaaatccgccaacctgctgcccatgaagaggatgactttcggacgcagtttttcgatgtggtagagaaaattatcgatgtgctcgggttgtgtgaacttgtcgggattgtcgatagtgttgccctgtgtagcagcccagttggtttgaaccagggatttttcaaatgcaccgcccaatccattttcgtctaaggggtgtccccacatttcaaaccaattttttatcgtattgtcgtaacgccacttttttgcctgctctccgaaatagagggatttgtttgcaaatgtatggtcgattttgttttcagggagtttgtattcacctgctacataagcagcctcatcggctttactccaaccccattcatagccacaaatcattaagccatgtttgtcgttgtagcctttgaacaggctgttgctcaaattcaaatccttcatcatgaactcttccttttaaaatttaagagcgattgacttcaatgtttttagatggggtggaaaaatccttgtgtaggcaacataaattcaataaatttcttgataattcgaaacctactaatagcgcacctataaaagctttttcattacgttcagcatgacggtcacgtcgttcatattttttacgcttgctgttccctgttattacagctaagccaagtgatatggcgagaattgcccaaacaatagtacttaataacaattttccccatactatcaataaggaaagaaaaaaccttttagtattagatcgataggttataatccatgcccatgaaaatgcaataagagttatacataagatacaagctgacaggatttctttatttttaattaaataacttagagcgatgaggatgacaggtgtcaagaaaataatagttacatcccgatagctataaaagaaaactgccctattttgaatgtggagatgtgcacagaatccaatatagctaaggataatagttaatataataaaaaaagaccaccaagggtgaagagataggaattccatgttttccctttttttgtaaaaaggaaaaaatcttatctaatagttaattgcctaaccagccagaagaagtttaaaatctatcccaataattcaaccatctatacagaaagttcagcttatggaaacccacgaaaaaatccgcctgatgcgcgaattgaataaatggtcccaggaggatatggcggaaaagctggcgatgtcggcaggcgggtatgccaaaatcgaacggggcgaaacgcagttaaatatcccgcgtttggagcagttggctcagattttcaaaatcgatatgtgggacttgctcaaatcgggcggtggtgggatggtgtttcagattaatgaaggtgatagtggtggcgatattgcgttgtatgcgtcgggtgatgtttcgatgaaaatagaatttttaaaaatggagttgaaacactgcaaagaaatgttggaacaaaaagacaaagaaatcgagctgctccgcaagctgaccgaaaccgtttaaacagatatgccgtctgaaaaaagttttcagacggcatattctttgacaggtcttgtataataccgtttgaacttacaggtttttgattatggcggcaggcaaacataccaaacacagcaaccgggtacgcattatcggcgggcaatgccggggcaggaaattgagtttcacatccgccgacggactgcgtccgacacccgacagcgtgcgtgaaaagctgtttaactggctgggacaggatttgacgggtaaaacggttttggatctcttcggaggcagcggcgcactcggtatagaagccgcttcgcgcaacgccaaacgcgtgctgatttcggataacaaccgccaaaccgtgcagaccttgcagaaaaacagtcgcgaactgggtttggggcaggtgcaaatcgtcttttcagacggcatcgcatatttgaagaccgtatccgaacagtttgatgttgtctttctcgacccgccgtttgcatggcaggactggcaaatcctgttcgatgccttgaagccgtgcctgaacccccgggcattcgtctatctcgaggcgggtacgctgccgaatattcccgattggctgacggaatatagagaagggaaatcggggcagagtacatttgaattaagggttttccaagtggctgaataatatgcgctttgataatcatttccgagttgtaaacattcgtttgcaaccgtccggttcaaaaaaaccttgtgctataatccgcgcccgcccggttttgataatttagtggaaaaggaaaagaaatgtcgctttttattaccgacgagtgcatcaactgcgacgtatgcgaacccgaatgccccaatgatgccatttcccaaggcgaggaaatttacgaaatcaaccccaacctctgcacgcagtgcgtcggacactacgatgagccgcagtgccagcaggtttgcccggtggactgcatcctgattgacgaagaacatcccgaaacccatgacgagttgatggcgaaatacgaaaagattatccagtttaaataaattctttttaaaacatcaaattatgtctgttttgaaataaaatcaaaaaaaaacttgacggaaaagcaagccgctaataaactaacgttctcttttggagggattcccgagcggtcaaagggggcagactgtaaatctgttgcgaaagcttcgaaggttcgaatccttctccctccaccaaaattcttacttggggcagtagcgagtaatgcgggtgtagctcaatggtagagcagaagccttccaagcttacggtgagggttcgattcccttcacccgctccaaacaattaggcccatgtagctcaggggtagagcactcccttggtaagggagaggtcggcagttcaaatctgcccatgggcaccatctctcgattattcatttctttaaggcttagatatataggatattgccatggctaaggaaaaattcgaacgtagcaaaccgcacgtaaacgttggcaccatcggtcacgttgaccatggtaaaaccaccctgactgccgctttgactactattttggctaaaaaattcggcggtgctgcaaaagcttacgaccaaatcgacaacgcacccgaagaaaaagcacgcggtattaccattaacacctcgcacgtggaatacgaaaccgaaacccgccactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtagaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaagtttagaggccaatagctcaattggtagagtatcggtctccaaaaccgagggttgggggttcgagaccctcttggcctgccaaataaaaaattaaccggccttgtgtcggttaatttttttgtatttgttatttagtaaactctcttgccatttacatggattgagaatagacagatgctatgatggataaataatatgacagaacatacgcctgaaaaaaagaacgttaaagtggatcaactggttgttcaagataaagaatctgcatctaattccggtaaggaagggttttttgcatatttctcaaattcttggtccgaattcaaaaaggtggtttggcctaagcgtgaagatgctgtcagaatgactgtatttgttatagtgtttgttgctgtgctttctatatttatctatgcggcagatacagcaatttcgtggttattttttgatgtattgctgagaagggaaggttgagatgtcgaaaaaatggtatgttgtacaggcgtattcggggtttgagaagaatgtccaacgaatattggaagagcgcattgcccgtgaggagatgggagattatttcggacaaattctggtgcctgtagagaaagttgttgatatccgcaatggtcgtaagactattagtgaaagaaagtcatatcctggttatgtgctagttgagatggaaatgacagatgactcttggcatcttgtaaaaagcaccccccgtgtttccggttttattggagggagggctaatagacctacgccgattagtcagagagaggctgaaattattttacagcaggttcagaccggcatagagaagccgaaaccaaaagttgaatttgaggtcggtcaacaggttcgtgtaaatgaagggccgtttgcggattttaacggggtggttgaggaggtcaattatgaacggaataagttacgcgtgtctgttcagatatttggtagagaaacacccgttgagctggagttcagccaggttgaaaagattaactgatttttatacttgaaaaaaaagcaataagaggatagaatcaaaaattaacttggggagcggaaatggttccgcgtcttacccgtttttaggagttcgttaagtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataatggctaaagtatctaaacgcttgaaagctcttcgctcttctgtggaagccaataaattatatgcaattgatgaagcaattgctttggtaaaaaaagcagcgactgctaaatttgacgagtctgttgacgtatctttcaacttgggcgttgatccgcgtaaatctgaccaagttatccgtggttcggtcgttctgcctaaaggcaccggtaagataacccgtgtggctgtatttactcaaggtgcaaatgcagaagctgctaaagaagctggtgcagatatcgtcggtttcgaagatttggctgctgaaatcaaagcaggcaatctgaactttgatgtcgttattgcttctcccgatgcaatgcgtattgttggtcagttgggtactattttgggtcctcgaggcttgatgccaaaccctaaagtaggtacggttactcctaacgttgctgaagcagttaagaatgcaaaagcaggtcaagtacaataccgtacagataaagcaggtatcgttcatgcaacgattggtcgtgcttctttcgctgaagctgatttgaaagagaactttgatgcgttgctggatgctatcgttaaagccaagcctgctgccgctaaaggtcagtatctgaaaaaagttgctgtgtctagcaccatgggtttgggtattcgcgttgatacatcaagcgtaaataactaatcttaaggaattttcaagcagtttggttttctgggctgcttgaatttgggctacttaaaattaagtagatgtccaagaccgtagggatcgtaagatttaatcgtaactgccctacgcagacggtagtcctgaaacacattgcaagattgcttgtaagatgtctttttaggttaccgcgctggtgggatatcgttttggtatcctgtttataaacagtgggaggtagaccttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactttggctcgtcgtgcagtgcaaggtacttcatttgcagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagccgcttaatcgattttgtttctgttaatcaattattttttaatacaatatttggagtaaaatagcatggctattactaaagaagacattttggaagcagttggttctttgaccgtaatggaattgaacgacttggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattaccggtttgggtctgaaagaagctaaagacatcgttgacggcgcacctaaaaccattaaagagggtgtttctaaagctgaagccgaagacatccaaaaacaactggaagaagcaggcgctaaagtcgaaatcaaataatttgatgcttcttatgaaggctggcagttttctgccagccttattttgcttcttaaaataaacatcaagtattgtttacatttatttgcatagtttttatcaagtcattgcaaataaatgtaaatatcagattgatgcgtaccgttgtttcagacggcctattattgaaaattacttttcggagtgtgtatgaactattcgtttaccgagaaaaaacgtatccgtaagagttttgcaaagcgggaaaatgttttggaagttcctttcttgctagcaacccaaattgattcttatgcgaagtttttgcagctggaaaatgcttttgacaaacgtaccgatgacggtctgcaggcggcatttaattctattttcccgattgtgagccataacggttatgcgcgattggagtttgtgcattacacattgggcgagcctttgttcgatattcccgaatgtcagttgcgcggaatcacttatgcagcccccttgcgcgcgcgtatccgtttggtgattttggataaggaagcatctaaaccgacggtaaaagaagttcgtgaaaacgaagtgtatatgggcgaaattccgttgatgaccccgagcggttcttttgtgattaacggcacagagcgtgtgattgtctcccagttgcaccgttcgcccggcgtattcttcgagcatgacaaaggtaagacgcactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttaggctacaacaatgagcaaatcttggatattttctacgacaaagaaacgttctatttgtcttcaaacggtgttcaaaccgatttggttgcagaccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaaccggaaagcctgctgggcaaagcattggctgccgatctgattgattcggaaaccggcgaggtattggcttctgccaatgatgaaattacagaagagttgttggccaaatttgatatcaacggcgtaaaagaaattacgaccctttatatcaatgagctggatcagggtgcttatatctccaataccttgcgtacggatgagactgccggccggcaggcggctcgtgttgcgatttaccgtatgatgcgtccgggcgaaccgcccaccgaagaggcggtcgagcaattgtttaaccgcttgttcttcagtgaagacagctacgatctgtcccgcgtaggccgtatgaaatttaatacgcgcacatacgaacaaaaactgtccgaagcccaacaaaactcttggtacggccgcctgctgaacgaaacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgccgagtacgttcggtaggcgagctgactgaaaaccaattccgtagcggtttggcccgtgtggaacgtgccgtaaaagaacgtttgaatcaggcggaatcagaaaacttgatgccgcacgatttgattaatgcaaaacctgtttctgccgctattaaagaattcttcggctccagccaattgagtcagtttatggatcagaccaaccccttgtctgaagtaacccataaacgccgtgtatctgcattgggtccgggcggtttgacccgcgaacgtgcaggatttgaggtgcgggacgtgcatccgacccactacggtcgcgtatgtccgattgaaacgcctgaaggtccgaacatcggtttgatcaactcattgtccgtttatgcgcgcaccaatgattacggtttcttggaaacgccttaccgccgcgttatcgacggcaaagtaaccgaggaaatcgattacttgtctgccatcgaagaaggccgctatgtgattgcacaggcgaatgccgatttggattcagatggcaatctgattggcgatttggttacctgtcgtgaaaaaggcgaaaccattatggcaacgcccgaccgcgtccaatatatggacgtggcaactggtcaagtggtatccgttgcagcatccctgattccattcttggaacatgatgacgcgaaccgcgcattgatgggtgccaacatgcaacgtcaggcagtgccttgcttgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaacttggttaaattcacccgttccaaccagtctaccaatatcaatcagcgtcctgccgtcaaagccggcgatgttttgcaacgcggcgatttggtggccgacggcgcgtccaccgattttggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgatactaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccaactgacgccggaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccattatcgattccgaattgaaacgctaccgtttggatttgaacgaccaattgcgtattttcgacaacgacgcattcgaccgtatcgagcgtatgattgtcggtcagaaagccaacggtggtccgatgaagctggccaaaggcagcgaaatcacgaccgaatatctggcgggtctgccgagcaggcacgattggttcgatatccgtctgaccgatgaagatttggccaagcagttggaactgattaaagtgagcctgcaacaaaaacgcgaagaagcggacgagttatacgaaatcaagaagaaaaaactgacccaaggcgacgaattgcaacccggcgtacaaaaaatggtgaaagtttttatcgccatcaaacgccgtctgcaagccggcgacaaaatggcgggccgccacggtaacaaaggcgtggtatcgcgcattctgccagtggaagacatgccttacatggcggacggccgtccggtagacatcgtactgaacccattgggcgtaccttcccgtatgaacatcggtcagattttggaagttcacttgggttgggcagcaaaaggtatcggcgagcgtatcgaccgtatgctgaaagagcaacgcaaagcaggcgagttgcgcgagttcttgaacagactctacaacggcagcggtaagaaagaagatttggatgccctgactgatgaagaaatcatcgaactggcctccaacctgcgcaaaggtgcatctttcgcctctcctgtattcgacggtgcgaaagagtctgaaatccgcgaaatgctgaacttggcttatccgagcgacgatcctgaggttgaaaaactgggcttcaacgacagtaaaacccaaatcacgctgtatgacggccgttcaggcgaagcatttgaccgcaaggttacagtaggtgtgatgcactatctgaaactgcaccacttggttgacgaaaaaatgcacgcgcgttctaccggtccgtacagtctggttacccagcagcctttgggcggtaaagcccagttcggcggccaacgtttcggcgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggcttggatatcgatttggaacgttactaaacaaaagttttcagacggcctttcagggtcgtctgaaaaagtggtttcagaataagaatgaagcaatcggcatttaggccgtctgaaatcaaaagtaccgtttcccaatatcgaaaatccgccatgcggtaaaaatacttccttcaaggagcaaaaatgaatttgttgaacttatttaatccgttgcaaactgccggcatggaagaagagtttgatgccattaaaatcggtattgcctctcccgaaaccatccgctcatggtcttatggcgaagtcaaaaaacctgaaaccatcaactaccgtacgttcaaacctgagcgtgacggtttgttctgtgccaaaatctttggcccggtcaaagactacgaatgcttgtgcggaaaatacaaacgcttgaaatttaaaggcgtaacgtgtgaaaaatgcggcgtggaagtaaccctgtccaaagtgcgccgcgaacgcatgggtcatatcgaattggctgcgcccgtcgcacatatttggttcttaaaatccctgccttcccgcttgggtatggtgttagacatgactttgcgcgacatcgagcgcgtattgtactttgaagcatttgtggtaaccgatcccggtatgactccgctgcaacgccgccaattgctgactgaagacgattactacaacaagctggacgaatacggcgacgatttcgatgccaaaatgggtgcggaaggtatccgcgaattgctgcgtaccctgaatgtagcgggcgaaatcgaaatcctgcgccaagagttggaatcgaccggttccgacaccaaaatcaaaaaaatcgccaaacgcttgaaagtattggaagccttccatcgttccggtatgaaactggaatggatgattatggatgtgctgccggtattgccgcctgatttgcgtccgttggttccattggatggtggtcgttttgccacttccgatttgaacgatttgtaccgccgcgttattaaccgtaacaaccgtctgaaacgtctgttggaactgcatgcgcctgacatcatcgtccgcaacgaaaaacgtatgttgcaagaagcagttgactcgctgttggataacggccgtcgcggtaaagccatgaccggcgccaacaaacgcccgctgaaatcattggcagacatgattaaaggtaaaggcggtcgcttccgtcaaaacctgttgggcaaacgtgtggactactccggccgttccgtgattaccgtaggcccgtacctgcgtctgcaccaatgcggtttgccgaaaaaaatggctttggaactgttcaaaccgttcattttccacaaattggaaaaacaaggtttggcctctaccgttaaagcagcgaaaaaattggtagagcaagaagtaccggaagtatgggacatcttggaagaagtcatccgcgaacatccgattatgctgaaccgtgcgccgaccctgcaccgtttgggtattcaagcgttcgaacctatcttgattgaaggtaaagcgattcagttgcacccattggtgtgtgctgcgttcaacgccgactttgacggcgaccaaatggcggtacacgttccattgagcttggaagcacaaatggaagcacgcacgctgatgctggcttcaaacaacgtattgtctccggccaacggcgaaccgattatcgtaccttcccaagacatcgtattgggcctgtactatatgactcgcgatcgtatcaatgccaaaggcgaaggcagcctgtttgccgatgtgaaagaagtgcatcgcgcataccataccaaacaggtcgagctgggtacgaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttctaaactgattaacgcatcgttccgcctgtgcggcttgcgcgatacggttatctttgctgaccacctgatgtacaccggtttcggatttgcggcaaaaggcggtatttccattgccgttgacgatatggaaattccaaaagaaaaagcggccttgctggctgaagccaatgccgaggttaaagaaatcgaagaccaataccgtcaaggtttggttaccaacggcgaacgctacaacaaggtggtcgatatttggggtcgtgccggcgataagattgctaaagcgatgatggacaacttgtccaaacaaaaagttatcgaccgtgccggcaacgaagtcgatcaagagtcattcaactccatttatatgatggcggactccggtgcccgtggttctgcagctcagattaaacagttgtccggtatgcgtggcttgatggcaaaacctgacggctcgattattgaaacgccgattacctcaaacttccgtgaaggtctgaccgtattgcaatactttattgcgacccacggtgcgcgtaagggtttggcggataccgcattgaaaaccgcgaactccggttacctgactcgtcgtctggtagacgtaactcaagatttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagtggcgaaaccttggttgaagccggtacgttgctgactgaaaaactggtggatatgatcgaccaatccggtgtcgatgaagtcaaagtccgtacgccgattacttgtaaaacccgtcacggcctgtgtgcacactgttacggtcgtgacttggcacgcggcaaactggttaacgccggtgaggcagtcggtgtgattgctgcacaatccattggcgaaccgggtacccagttgaccatgcgtacgttccacatcggtggtgcggcatcccgtgcggcagcagccagccaagtggaagccaaatccaacggtacggcacgattcagcagccagatgcgctacgttgccaacaacaaaggcgagttggttgtcatcggccgttcttgtgaagtcgtgattcacgacgatatcggccgtgaacgcgaacgccacaaagtaccttacggtgccatcctgctggtacaagacggtatggccattaaagccggtcaaaccttggcaacctgggatccgcatacccgtccgatgattaccgaacacgcaggtatggtgaaattcgaaaacgtggaagagggcgttaccgttgccaaacaaaccgatgatgtaaccggtttgtccactttggtggtgattgacggtaaacgtcgttcctctagtgcttccaaactgctgcgtccgactgtgaaactcttggacgaaaacggcgtggaaatctgtattcccggtacttctactccggtatccatggcattccccgttggtgcggtgattaccgtacgcgaaggtcaggaaatcggtaaaggcgacgtattggcgcgtattccgcaagcctcttccaaaacccgcgacattaccggcggcctgccgcgcgttgccgaattgtttgaagcacgcgtgccgaaagatgccggtatgttggcggaaattaccggtaccgtttccttcggcaaagagaccaaaggcaagcaacgtctgattgttactgacgtggacggtgtagcatacgagaccttgatttccaaagagaaacaaattctggtacacgacggtcaagtggtaaaccgcggtgaaaccatcgtggacggcgcggtcgatccgcacgatattctgcgtttgcaaggtatcgaagcactggcacgctacattgtccaagaggtgcaagaggtttaccgtctgcaaggtgtgaagatttctgataaacacatcgaagtcatcatccgtcaaatgttgcgccgtgtgaacattgcggatgccggcgaaaccgggttcattaccggagagcaggtcgaacgcggcgatgtgatggcggccaatgaaaaagctttggaagaaggcaaagaaccggcgcgttacgaaaacgtattgctgggtattaccaaagcttccctgtccaccgacagcttcatttctgccgcatcgttccaagaaacgacccgcgttctgaccgaagccgcgattatgggcaaacaagacgagttgcgtggtttgaaagaaaacgtcatcgtcggtcgcttgattcctgccggtaccggtttgacttaccaccgcagccgtcatcaacaatggcaagaggtggaacaggagactgccgaaacccaagtaacggatgaataatctttggtgcatccattcaataaaaaaccgcaagccttgagcttgcggtttttctttgtccgattaaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcgtctgaaacttcagacggcatttcctttaagaaataaatatgaaacccagaaatctcttttttgcaggctgcctgctgacttcggcgacgtttgccgaggatatcggcgtacctgtcgaactgattaacgtcggtaatcggattgcgatgccgtctgaaggggaaagcctcgccctcctgccgtttgccgaggatgtaccgccggttcgcgatgcaatgccgtctgaagttcctaaaagcgcggcaggcggcgatgttcggggtgaccggatgagaatgccgattaacatcggatgagcgcggctttatggcataaaaaactgtcgtggaaaggatttacaccccaaataaatttccgttacaacaagatcaacagcaatatgcccgccttttattcgcgcagcggcaaggaacggtttgtcagtatagaaaaaacgtattgacagtattttcttcagtcgtccgactgattgtgagggatgtcggtaaatatttatcggcaaacaagaaaatcatctttcttcttgtcgttatgcttgactgtctgcttgcaataaaaatataattccactcttgccgacatggtgtcggcaagtatttaactcaacaggacgagaaaatatgccaactatcaaccaattagtacgcaaaggccgtcaaaagcccgtgtacgtaaacaaagtgcccgcactggaagcttgcccgcaaaaacgtggcgtgtgcacccgtgtatacacaactacccctaaaaaacctaactctgcattgcgtaaagtatgtaaagtccgcctgaccaacggttttgaagtcatttcatacatcggcggcgaaggtcacaacctgcaagagcacagtgtcgtattgattcgcggcggtcgtgtaaaagacttgccaggtgtgcgttaccacactgtacgcggttctttggatactgcaggtgttaaagaccgtaaacaagcccgttccaaatacggtgctaagcgtcctaaataattactgggacttaaataggcacgtcggccgcctaagctgaacaacggccgagtaagtgaatactcaattgggtattcatgggaatagacccgactgaatagattaaaggaaattaaaatgccaagacgtagagaagtccccaagcgcgacgtactgccagatcctaaattcggcagcgtcgagttgaccaaattcatgaacgtattgatgattgacggtaaaaaatccgttgccgagcgtatcgtttacggtgcgttggaacagattgagaaaaaaaccggcaaagtagcaatcgaagtatttaacgaagccattgcaaacgccaaacctatcgtggaagtgaaaagccgccgtgtaggtggtgcaaactaccaagttcctgttgaagttcgtccttcacgccgtttggctttggcaatgcgctgggttcgcgatgcggcccgcaaacgtggtgagaaatccatggacctgcgtttggcaggcgaattgattgatgcgtccgaaggccgtggcggtgcgttgaaaaaacgtgaagaagtacaccgtatggctgaagccaacaaagcattctctcacttccgtttctaattttgaaaggctaataaaatggctcgtaagaccccgatcagcctgtaccgtaacatcggtatttccgcccatattgacgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccgggacacgttgactttaccgtagaggtagagcgttctatgcgtgtattggacggcgcggtaatggtttactgcgcggtgggcggtgttcaaccccaatctgaaaccgtatggcggcaagccaacaaataccaagtgccgcgcttggcgtttgtcaataaaatggaccgtcagggtgccaacttcttccgtgttgtcgagcaaatgaaaacccgtttgcgcgcaaaccctgtacctatcgtcattccggttggtgcggaagacaacttcagcggtgtggttgatttgttgaaaatgaaatccatcatttggaatgaagtcgataaaggtacaacctttacctatggcgatattcctgccgaattggtcgaaactgccgaagaatggcgtcaaaatatgattgaagccgcagccgaagccagcgaagaactgatggacaaatacttaggcggcgacgagctgaccgaagaagaaatcgtaggcgcgttgcgtcaacgtactttggcaggcgaaattcagcctatgctgtgtggttctgcatttaaaaacaaaggtgttcaacgtatgttggacgcagttgtagaattgctgccagctcctaccgatattcctccggttcaaggtgtcaacccgaataccgaggaagccgacagccgtcaagccagcgatgaagagaaattctctgcattggcgttcaaaatgttgaacgacaaatacgtcggtcagctgacctttatccgcgtttactcaggcgtagtaaaatccggcgataccgtattgaactccgtaaaaggcactcgcgaacgtatcggtcgtttggtacaaatgactgccgcagaccgtactgaaatcgaagaagtacgcgccggcgacatcgcagccgctattggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgtgtccgtacagacgaagaatccggtcaaaccattatttccggtatgggtgagctgcacttggaaattattgttgaccgtatgaaacgcgaattcggtgtggaagcaaatatcggtgcgcctcaagtggcttaccgtgaaactatccgcaaagccgttaaagccgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccaatcatggcagttgaagtggaaaccccggaagaatacatgggcgacgtaatgggcgacttgaaccgccgtcgcggtgttgtattgggtatggatgatgacggtatcggcggtaaaaaagtccgtgccgaagtacctttggcagaaatgttcggttactcgaccgacctgcgttctgcaacccaaggccgcgctacttactctatggagttcaagaaatattctgaagctcctgcccacatagctgctgctgtaactgaagcccgtaaaggctaatcagaaaaggccgtctgaaactgaaaataaattttcagacggccattgttctttaatcgatctttatatgtaaaggaattagctcatggctaaggaaaaatttgaacgtagcaaaccgcacgtaaacgttggcaccatcggtcacgttgaccatggtaaaaccactctgactgctgctttgactactattttgtctaaaaaattcggtggcgctgcaaaagcttatgaccaaatcgacaacgctcctgaagaaaaagctcgtggtattaccattaatacctcacacgtagaatacgaaactgaaacccgtcactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtggaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaattgaaggatattgataaatggcaaaccaaaaaatccgtatccgcctgaaagcttatgattacgccctgattgaccgttctgcacaagaaatcgttgaaactgcaaaacgtaccggtgcagttgtaaaaggcccgattcctttgccgaccaaaatcgagcgtttcaacattttgcgttctccgcacgtgaacaaaacttcccgtgagcaattggaaatccgcacccacttgcgcctgatggacatcgtggattggaccgataaaactaccgatgcgctgatgaagctggatttgccggccggtgttgatgtagaaatcaaagtccaataattcggactataaaaaatccccaagcaatcaatgcttggggattttttatgttatgccgagacctttgcaaaattccccaaaatcccctaaattcccaccaagacatttaggagcaccttcttccagcaaaccgcccaagccatgattgccaaacacatcgaccggttcccactattgaagttggaccgggtaattgattggcagccgatcgaacagtacctgaatcgtcaaagaacccgttaccttagagaccaccgcggccgtcccgcctatcccctgttgtccatgttcaaagccgtcctgctcggacaatggcacagcctctccgatcccgaactcgagcacagcctcatcacccgcatcgatttcaacctgttttgccgctttgacgaactgagcatccccgattacagtcatcaaccatattccggtttgtcggagaaagatgcatacgctgtgatgaccggataccgacccgttaaaagagtccgaccctatgccgtctgaaaattcaaaacgcttcagacggcatattgaagatatttctgatatttctgttgatatttctttgacttgtcagatataatgccgagcttggtacatttgtgccaagtttaactttgtctgaaagacaggccaatcgtagcctgtccctttactttaaaaggaaaataatcatgactttaggtctggttggacgcaaagttggtatgacccgcgtgttcgacgaacagggtgtttctgttccggtaaccgttttggatatgtctgccaaccgcgttacacaagtaaaatccaaagatactgacggctatactgccgttcaagttacctttggtcagaaaaaagccaatcgtgtcaacaaagccgaagccgggcactttgcaaaagcaggtgttgaagccggtcgcggtttgattgagtttgctttgactgaagaaaaactggctgaattgaaagctggtgacgaaatcaccgtttctatgtttgaagtcggtcaactggtcgatgtaaccggtacctctaaaggtaaaggtttctccggcacgattaaacgtcataacttcggtgcccaacgtacttcccacggtaactcccgttctcaccgtgttccaggctctatcggtatggcgcaagacccgggtcgcgtgttccccggtaaacgcatggccggccaatacggcaacaccaaagcaactgttcaaaaattggaagttgtccgtgttgacgcagaacgccaactgctgttggttaagggtgctgttccgggtgcggtcaacagcgatgttgtagttcgtcccagcgtgaaagtaggtgcgtaatggaattgaaagtaattgacgctaaaggacaagtttcaggcagtctgtctgtttctgatgctttgttcgcccgcgaatacaatgaagcgttggttcatcagctggtaaatgcctacttggcaaacgcccgctccggtaaccgcgctcaaaaaacccgtgccgaagtaaaacactcaaccaaaaaaccatggcgtcaaaaaggtaccggccgtgcccgttccggtatgacttcttctccgctgtggcgtaaaggtggtcgcgcgttcccgaacaaacccgacgaaaacttcactcaaaaagtaaaccgcaaaatgtaccgtgccggtatggcgactattctgtcccaattgactcgtgacgagcgtttgtttgcgattgaggcgttgactgccgaaactcctaaaaccaaagtttttgccgaacaagtgaaaaatctgggtctggagcaagtgttgtttgtaaccaaacagctcgacgagaatgtttacttggcttcacgcaacttgccaaacgtgttggttttggaagctcaacaagttgatccttacagcttgctgcgttacaaaaaagtaatcatcactaaagatgcagttgcacaattagaggagcaatgggtatgaatcaacaacgtttgactcaagtgattttggcacctatcgtttctgaaaaaagcaacgtattggctgaaaaacgtaaccaaatgacgtttaaagttttggcaaatgcaaccaaacctgaaattaaagcggctgttgagctgctgttcggcgttcaagttgcagacgttactactgttaccattaaaggtaaagttaaacgttttggtcgcactttaggtcgtcgcagcgatgttaaaaaggcttatgtaagcttggctgccggtcaagagttggatttggaagccgctgctgcagctgcagataaggaataaacaaaatggcaatcgttaaaatgaagccgacctctgcaggccgtcgcggcatggttcgcgtggtaacagaaggtttgtacaaaggtgcaccttatgcacctctgctggaaaagaaaaattctactgccggtcgtaacaacaatggtcatattactacccgtcataaaggtggtggtcataaacatcattaccgcgtcgtagattttaaacgtaacaaagacggtatccctgcaaaagtagagcgtatcgaatatgaccctaaccgtactgcatttatcgcactgttgtgctatgcagatggtgagcgtcgctacattattgctcctcgtggtattcaagccggtgcagtattggtttccggtgctgaagctgcgatcaaagtaggtaacactctgccgatccgcaatattcctgttggtacaactattcactgtatcgaaatgaaaccaggtaaaggtgcgcaaattgcacgttctgccggtgcttctgcggtattgctggctaaagaaggcgcgtacgctcaagtccgcctgcgctctggcgaagtccgtaaaatcaacgtagattgccgtgcaaccatcggtgaagtcggtaacgaagagcaaagcctgaaaaaaatcggtaaagccggtgccaatcgttggcgcggtattcgtccgactgtacgtggtgttgtcatgaaccctgtcgatcacccgcatggtggtggtgaaggccgtacgggcgaggcccgcgaaccggtcagcccatggggtactcctgctaaaggctaccgcactcgtaataacaaacgcacggataacatgattgttcgtcgccgttactcaaataaaggttaatttagtatggctcgttcattgaaaaaaggcccatatgtagacctgcatttgctgaaaaaagtagatgctgctcgcgcaagcaacgacaaacgcccgattaaaacctggtctcgtcgttctaccattctgcctgattttatcggtctgaccattgctgtgcacaacggccgcacccatgtgcctgtgtttatcagcgacaatatggttggtcataaattaggcgaattctcattgacccgtacctttaaaggccacttggccgataaaaaggctaaaaagaaataaggtgaatcatgagagtaaatgcacaacataaaaatgcccgtatctctgctcaaaaggctcgtttggtagctgatttgattcgtggtaaagacgttgcccaagctttgaatattttggctttcagtcctaaaaaaggtgccgagctgattaaaaaagtattggagtcagctattgctaatgccgagcacaataacggtgcggacattgatgaactgaaagtggtaactatctttgttgacaaaggcccaagcttgaaacgttttcaagctcgcgccaaaggtcgcggtaaccgcatcgaaaaacaaacttgtcatatcaatgtgacagtgggtaactaaggaaaagctatgggacaaaagattaaccctacaggctttcgcctggcggtaactaaagactgggcttcaaaatggtttgctaaaagcaccgacttttctactgttttgaagcaggatatcgatgttcgcaattatttgcgtcaaaaattggccaatgcttcggttggtcgagtggttattgaacgccctgcaaaatctgcacgcattaccattcactccgctcgtccgggtgtggttatcggtaaaaaaggtgaggatatcgaggttttgaaacgtgacttgcaagtcttgatgggtgtacctgttcatgtaaatattgaagagattcgccgtcctgagttggatgctcaaattattgctgacggtattgcccagcagttggaaaagcgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcatatcaaacgtggtggtcgtatttggattcgtgtattccctgataaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaataatgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaagtaatgagcgaaactaaaaatgttcgtactttgcaaggcaaagtagtaagcgacaaaatggataaaaccgtaacagtattggttgagcgtaaagtaaaacatccgctgtatggtaagattattcgattatctactaaaatccatgcccatgatgaaaataatcaatatggaattggtgatgtggttgttatatcggaatcccgtccattgtcaaaaactaaatcttgggttgtcagtgagctggttgagaaagcacgttctatttaagaattaaagcaacgtgcttggaatgggaaacgaagtattgcagcaaatttaatttgcgtgtaaacttcgtttcctgtctttcagtttcttctggaagtttcttccctttcggggtccaagactggtttacttgaaccgcaaggtttcatttaataagcagcggctttgctgtaagttatctgaaagtggtaaattaagttggttaatttaaaggtaataacatgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggctccgcgtggccgtgtcaaaaaaggcgatgtatataatgcggtagttgttcgtactgctaagggtgtacgtcgtcctgatggtgcgttaattaaattcgataacaatgccgccgtgttactgaataataaacttgaacctttgggtactcgtatctttggtccggtaacccgtgaattgcgtactgagcgatttatgaaaatcgtttcattggcacctgaagtattataaggaatggcacgatgaataaaatcattaaaggcgatagggttgtagtaattgctggtaaggataaaggtaagcagggtcaagtagttcgagtgttgggtgataaagttgttgttgagggcgttaatgttgtaaaacgccatcaaaaacctaatccaatgcgtggcattgagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggggcataaggagataacatggctcggttgagagagttttataaagagacagttgttcctgaattggttaaacaatttggttacaaatcagtaatggaagtcccgcgtattgaaaaaattaccttgaatatgggtgtgggtgaggctgttgctgataaaaaagttatggaacatgctgtttccgatttagagaaaattgccggtcaaaaaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggccgtggcaattacaatatgggtgttcgtgagcaaattatttttccggaaattgaatacgataaaattgatgctttgcgtggtttgaatattactattactactacagcaaaaaccgatgaggaagcgaaagctttattgtcattgtttaaatttccgttcaaaggataatcatggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctggtaataggagtaattaagaatgagtatgcatgatcctatttccgatatgttgactcgtatccgcaatgcgcaacgtgctaataaagcagcggttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctattgttagtacttctaaaggtgtaatgactgatcgtaaagcacgttctcaaggtgttggtggtgagttgttatgcattgtagcctagtggaggaaaagaaatgtcacgtgtcgcaaaaaacccagtgactgttcccgctggtgtagaagtaaaatttggagcagaggcattagttattaagggtaagaacggtgaattgtcttttcctttgcattctgatgtagccattgaatttaatgatggcaaattgacttttgttgcgaataacagcagtaaacaagcaaatgcaatgtctggtactgctcgcgcattagtcagcaatatggttaaaggtgtttcagaaggttttgagaaaagattgcaattgataggtgtgggttatcgtgctcaagcacaaggtaaaatcttgaatctgtctttgggtttttctcatccgatcgtatatgaaatgcctgaaggtgtctccgttcaaactcctagccaaacagagattgttttaaccggctcggataaacaagttgttggtcaagttgctgctgagattcgtgcgttccgtgctcctgagccttataaaggtaaaggtgttcgctatgtaggagaagtagtggtaatgaaagaagccaagaaaaaataattgaggttcactaatggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtatcgctgaaaaagctaaagcagcaggtgtagaaaaggttgcttttgatcgttcaggtttccaatatcacggtcgtgtgaaggctttggctgaagctgctcgtgaaaatggtttaagcttctaaatatttggagactttcagatggcaaaacatgaaattgaagaacgcggtgacggtctgattgaaaagatggtcgctgttaatcgcgtaactaaagtagttaaaggtggccgtatcatggctttctcagcactgactgttgttggtgatggtgatggtcgcattggtatgggcaaaggtaaatcaaaagaagtaccagttgctgttcaaaaagcaatggatcaagctcgacgctctatgattaaagtacctttgaaaaacggtactattcatcatgaggttattggccgtcatggtgctactaaagtatttatgcagcctgctaaagagggtagtggcgtaaaagccggtggacctatgcgtttggtttttgatgctatgggcattcataatatctccgccaaagtgcacggatctactaacccatataatatcgtacgtgcaacattagatggtttgtctaagttgcatactcctgctgatatcgcagccaaacgtggcttgacagtggaagacattttgggagttaaccatggctgaacaaaaaaagattagggttacattggttaaaagcctgattggtacaattgaatctcatcgtgcatgtgcacgcggtttaggtttgcgtcgtcgcgagcatacggtagaggttttagatacccctgaaaaccgtggtatgattaataaaatcagctacttgttgaaagtggagtcttgatatgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagcatcagctaatgcacagcttcgtttaagtgaactggaatcaattgctgttaatgagattgatattttggtcttaaagcaagcgggtctgattgcatctacagtctctaatgttaaagttattgcttctggtgaaatttctaaggcagttgctttgaagggtattaaagttaccaaaggtgcgagagctgctatcgaggctgttggtggtaagattgaaatgtaaggtttaatattgtggctaatcaacaaacgtcatcaggttcatccaaatttggagatcttaagaaacgtcttttgtttctatttggagcattgattgtttttcgaattggtgcccatatacccgtacctggagttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgtttattgtatttggtgccttattattaatttatttggttgtatactttgaaagtgcacagcggaagattcctattcattatgcaaaacgccagtttaatggtagggcgggtagtcaaaatacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagccctaaagaaatggcagagaatttaaaaaagagtggtgcttttgttcctgggattagacctggtgagcagacctctaggtatttagaaaaagttgtattacgtttgacattgtttggagctctttatattacaactatttgtttaattccagagttcttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctccgtcacaaacagcgtcaaggttaatggaatatttcttttaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgaccaagttgccaagtatgaagtagaaggtgatttgcgtcgtgaggtaactatgagtatcaagcgattgatggacatgggctgctatcgtggcttccgtcatcgtcgcggcttaccatgccgcggtcaacgcactcgtacaaatgcgcgtacccgcaaaggtccgcgtaaagcgattgctggtaagaaataaattttaaggaattttattaatggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgtgaatcctctgtacgtgctttgaatgctcttggtttcaagattaccagcattactgacgttaccccgttgcctcataacggttgccgtccgcctaaaaaacgtcgtatttaatattggagtgatttgaaacatggcacgttatattggccctaaatgtaagttggcacgtcgcgaaggtacggatttgtttttgaagagtgcgcgccgctctttggattctaaatgtaaaattgattccgctcctggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgtcgtaaaggttctaccggcgagttgctgttgcagttgctggaatctcgtttggataatgtcgtttatcgtatgggtttcggttctacccgagctgaagcaagacagcttgtttctcataaggcgatagttgtgaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcggataaacttgagggtgtgttcaaaaacatgccggatcgctcggaattgaccggtgatattaatgaacagctggtggtagagttctactctaaataatgctagctcagtgagggacagttaaatgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattacacgaatattctactgttgatggtattcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgagatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtacgcctgtggaggaggttgaagaaaaagcacctcctatcgaccctgttcttttgcgtccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagccttaatgaagaattaaaggataattgatatgcgtcatcgtaatggcaatcgcaaattaaaccgtaccagcagtcatcgtgctgcaatgctgcgtaatatggcgaattcattattgactcacgaagctattgtaacaactctgcctaaggccaaggaattgcgccgtgtagtagagccgttgattacattgggtaaaaagccgtcattggcaaaccgccgtttggcatttgaccgtactcgcgaccgtgatgttgtagtaaaactgtttggcgatttgggtcctcgttttactgctcgtaacggtggttatgttcgggtgttgaaatacggattccgtaaaggtgataatgcacctctggcactggttgaattggttgacaaaccggctgctgagtaattttagtcatataacgccatctgccgaaaagcaggtggcgttatttttgcaatatctgataggtaatagggtattggctatcatgtttaaaatattaattgaatagctaaggtttgcgcggtaaacttacatcattaaaaaattctatgatggtttatataatgaatgctttcgatataaagtcgacaaagatggacgtattgtctatatctttgcatacgtcagacttgtttgatttggaagatgtgctggtcaaattgggcaagaagtttcaagagtctggtgttgttccatttgtgctggatgttcaagagtttgattatcccgagtctttggatcttgctgcattggtttcgttgttttcaaggcatggtatgcaaattttgggtctgaagcattctaatgaacgttgggctgctgcggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcggatggcaatatacatatttatgcgccgatgagggggcgtgctttggccggtgccaagggtgatacttctgcccgcatatttatccactccatgcaggcagaactggtttctgtggcgggtatttaccgtaattttgaacaggatttgccgaaccatctgcacaagcagccggtacagatattgttgcaggataaccgattggttatcagtgcaattggctcagagtaattgtttgatatttaaaaaggaaatattgtggcaaaaattattgtagtaacttcaggtaagggcggtgtcggtaaaacgactaccagtgccagtattgcgacaggtttggcattacgcggatataaaactgcggtaattgattttgatgtgggtttgcgtaacctcgacctcattatgggttgcgagcgtcgtgtcgtttatgacctgatcaatgtcattcagggggaggcgacgctcaaccaagctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgccggtattgagcagggtgcattgatggcgttgtattttgctgatgaagccattgtaacgaccaatcctgaggtttccagtgtgcgtgactccgacaggattttgggaattttgcaaagcaaatcccataaggcagagcaaggcggttcggttaaagaacatctgttgattacgcgttattctcccgaacgtgtggcaaaaggcgaaatgctgtctgtacaggatatttgcgatattctgcatattcctttgctgggtgtgattcctgaatcccaaaacgtcttgcaggcatccaattccggagaaccggtcatccatcaggacagcgtggcggcttccgaggcatataaggacgttattgcccgtcttttgggcgagaaccgtgaaatgcgtttcttggaagctgagaaaaaaagcttcttcaaacgtctgtttggaggataaggtatgtcattaatcgaatttttattcggcagaaagcagaaaacggcaaccgttgcccgcgaccgccttcaaatcatcattgcccaagagcgcgcccaagaaggtcaggctccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggtataggacatgaccttaaccgaattgcggtacatcgtcgcagtcgcccaagaacgtcatttcggcagggcggcgcggcgttgttttgtcagccagcccactttgtctattgccattaagaaattggaagaagagcttgccgtctctttgtttgaccggagcagtaacgatattattacgaccgaggcgggggaacgtatcgttgcacaggcgcgtaaggtattggaagaggcggagcttatcaggcatttggcaaatgaagaacaaaacgagctggagggtgcgttcaaactcgggctgatttttacggttgcgccgtacctgctgccgaaactgattgtttcgttgcgccgtactgcaccgaaaatgcctttgatgttggaagagaattacacgcatactttgaccgagtcgctcaaacgcggggacgttgatgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacaacgtatacaggggttgaccaatacattgcagggcagctcgattaatacaatccgccatatggttgccagcggtttggcaatcagcgtgttgccggcaaccgcactgaccgaaaacgatcatatgctgttcagcattattccgtttgagggtacgccgccaagccggcgggtcgtattggcgtaccgccgcaattttgtccgtccgaaggcgttgtcggcgatgaaggcggcgattatgcagtcgcagcttcacggggtaagttttatctgcgactaggcgcaggcattgttttcaaaacgccatttccctgagccgacaacacggtatgccaagatattgccgtcatcatcgattttgagtatagcatcgccacggaaactgccgtcctgaagatattcgacttttgcatcactgtgaatgttttcatcagtgccgatgcaatgccatgtatagtggattaacaaaaaccagtacggcgttgcctcgccttgccgtactatttgtactgtctgcggcttcgtcgccttgtcctgatttttgttaatccactataaaagaggccgtctgaaaaacatttttcagacggccttgtttattcaatcaaatcagtctttcaacttcgccaactgattttgaacttttgccattttgtcttccaattccgccaaatcggctttgtctttttccaccagatgcgcaggggctttttcggtgtagccgggtttggagagtttggcgttgagtttgtccaaggctttttgcagcttctcggcttctttgctcaaacgggcggtttcggcggctttgtcgatttcgactttcaacatcaggcgcgcgccgttgcagacggcgacgggcgcgtcttcgctttcgggtagggcggcgacttgctgtgcttcggtcaggcgggtcatcatcggcaggtatttgaggtagtccgccaagtcgtccgtgctttcgacaaacagcggggcttttacgttgggctggatgcccatttcgccgcgcaggttgcggactgcgccaatcaaatcctgcaacacggtcatttgctcgaatgccgtctgaacaatctcgccgctgtcggcttcggggaagcgggcgagcatgatgctgtcggcggttttcgcgtcgcacataggagcgacggtttgccacagttcttcggtgatgaacgggataatcgggtgcagcaggcgcagggcggcttcgagtacgcgcaataaggtatggcgtgtggcgcgttggcggctggcgcagccggtttgaagctgcactttggcgagttccaaataccagtcgcaatagtcgttccatacgaagctgtacagggtttccgccgccaaatcaaagcggtaggtttcgtaggcttgcgtaacctgttcgatggtctgattcagacggcctacaatccacatatcggggaaggagtagccgcgcggttcggcagcggttgcgccgtaaccgcagtcttggttttcggtgttcatcaagacgaagttggtggcgttccagattttgttgcagaagttgcggtagccttcggcgcgtttgaagtcgaagttgaccgaacgccccaagctggcgtagctcgccatagtgaagcgcaaagcgtccgcgcccatactcggaatgccttcggggaagagttttttcgtggcttcttccactttcggcgcggtttcgggtttgcgcaggccggtggtgcgttttaccagcagtttttccaagccgatgccgtcgatcaaatccacagggtcaatgacgttgccttcggatttggacatttttttgccttcgtggtcgcgcacgatgccgtggatgtacacgtctttaaacggtactttgccggtgaagtgggtggtcatcataatcatacgcgccacccagaagaagatgatttcgtagccggttactaagacattggacggcaggaaggctttgagttcgtcggtttcagacggccagccgagtgtggagaacggcacaagcgcggaggagaaccatgtatccaatacgtcttcttcgcgagtcaagcctgttttgccggcttgtttttcggcttcttcctgattgcgggcaacatacacattgccttcgttgtcgtaccatgcagggatttgatggccccaccacagttggcgtgagatacaccagtcttggatgttgttcatccattggttgtaagtgttgacccagttttcagggataaagcgtaccgcgccgctatcaacggcttttttggctttatcggcgaggctcaagcctttgaactcgctgtccggctcgccgccgtttggggtggcggacatggcgacaaaccattggctggtcagcataggttcaatcaccgaacctgtacggtcgcctttcggcgtcatcagcgtgtgtggtttgatttcgaccaagaaaccttgttcctgcaaatcggcaaccatttgtttgcgcgcggcaaagcggtctaagcctgcgtatttttcaggcagggcaaagcctagttgcgcttcgcctttgaagttgaacacttcggcgtttgccagcactttggcttccaagttgaacacattaatcaggcgcgtgtcgtggcgtttgccgacttcgtagtcgttgaagtcgtgtgcaggcgtgattttcacgcagcctgtgccgaagtctttttcaacgtattcgtcggcaatcacggggatagtacggccggtcagcggcaggattaattccttgccgattaagtgggtataacgttcgtcttcaggattgacggcaacggcaacgtcgcccagcagcgtttcaggacgggtggtcgccacgataacggcttcggcgggattgtccgccagcggatagcggatgtgccacatagagccttgttcttccacgctttccacttccaaatccgataccgccgtgccaagcacgggatcccagttcaccaagcgtttgccgcggtaaatcaagccttgctcatacaggcgcacgaacacttcggttacggtttcggcgcgcacgtcgtccatcgtgaaatactcgcgcgtccagtcggcagagcagcccacgcggcgcatttgttgggtaatcgtgccgccggaaacttctttccattcccacactttctccaaaaatttttcgcgacccaagtcatggcgggacacgttttgcgcagcaagctgacgctcaaccacaatctgcgtggcgatgcccgcgtggtctgtgccgggaatccaggcggtgttgcagcctttcatgcggtagtagcgggtcagaccgtccataatggtttggttgaaggcatgacccatgtgcagcgtgccggttacgttgggcggcggcagttggatggagaaagacggtttcgtcaaatccatatcaggttggaaatagccctgctcttcccagttttgataatgtttggattcgatttcggctggattgtatttgtctaacatgatggaactttgtgaaattaaggttatttttgatgtgcggattataacgcaaaaaggccgtctgaatcatttcagacggcctttggcatacaggttttaaaaatggaacaataccaggctgacggcaatcaccgccatacccgttgtcaggccgtaaacggtttcatggccgtctgaatagcgtttggcagccggcagcagctcgtccaacgccaaaaacaccatcacaccggctatcacgccgaataccgaaccaaacacggcaggcgacaaaaacggctgcaaaaccaaatagcccaaagccgcccccaacggctcggccaagccggatagcagacacgcccacaccgttttcttacggctgcgggtggcaaaataaaccggcgcggcgatggaaatgccctccggaatattatggatggcaatcgccaaggccaaaggcatcccgactgctggattttccaatgtggcaaaaaacgtcgccaagccttcggggaaattgtgcgcagtaatcgcaaacgccgccatcatgccgactcgcgcgatatggcggcgtttgctttcttgaaacgacgggtcttgcgcgtctaaagtttcatgcgggttcggcaccagacggtcaatcagcgcaatgccgcccatcccggccaaaaatgccatggtcgccgccgcaaacgcgtggtctttatcataaatttcagcgaacgcctcgctggacttactgaaaatctccgtcagggaaacatataccatcgcaccgccggcaaacgccaaaccaaacgacaacacacgcggattgggcgttttggaaaacatcaccaagccactgcctaatacggtaaacaaaccggcagccaatgtgatggaaaaggcaacggccaaattggacatcgaaaaatcgggcatgagaaaacctgcgctaaaagctgggacaggttcagactaacactttttaatgtatatgataatagttattatttattttattgattggatacacggattttgaaacaaaaggccgtctgaaaaatgattttcagacggcctttaaatttgaaatgccgctaaaccttagtgctttccagcttaagcctgataacgcgacaggctcaaatcgtcgctgcggatttcggtgtctttgccgctcacgatatcggcggttaattttgccgaacccagcgacatggtccagcctaaagtaccgtggccggtattcagaaacaggttgtcaaagcgggtgcgaccgattaacggcgtgctgtcgggcgtcatcggtctgaggccgctccagaacgatgcttggctcaaatcgccgccttccgggaacaagtcgttgacgaccaaagccaaggtttcgcggcgtttttcgggcagtttgatttcgtagcccgacaattccgccataccgccgacgcggattctgttgtcaaagcgcgtgatggcgactttgtagctttcatctaaaacggtggacaccggtgcgccgtctgaattggtgaccggcagggtcaaggaatagcctttgacgggataaatgggcagattgagatccaactgcgccaaaaccgtcctgctgaagcaaccgagcgcgcagacaacggcatctgcttcaaaccgccctgtttcggtttcaacggttttgatgcgcagcccgttgtggtcgatgcggctgatgttttggttgaaatgaaaccgtacgcccttttcctgacacaatttgtataggttttcagtgaagaggcggcagtcgccggtcgcatctgcaggcaggtgcaggccgccggcaattttggcggtaacgcgtgccagcgcaggctcaaattctgcacattcttcgggtttcagacggcggtacggcacgccgtagcgttccaaaacggcaatgtcttgttttgccgcttcgacttctttggtttggcggaaaatctgcaacgtcccttttttgcgtccctcaaaattcatgccggtttgcgcttcaaaacggcggaacatttcacggctgtattcggaaatcctgaccatgcgctctttattggtttgatagtgcgctgccgtgcagttttgcagcatttgccacagccattcgatttgatacaggctgccgtcggggcgaaacagcaaaggcggatggcttttaaacagccatttcagcgctttggtcgggataccgggtgcagcccaaggcgtggtatagccgtaagaaagctggcctgcgttggcaaaactggtttccatcgccacaccctcggcgcggtcgatgaccgttacttcatgtccggcctctgccagataccacgcggaagacacgccggcaacacccgcacctaaaacaagcactttcatgtttctccctccggctttttcaaaacagacttaatatgccgtgccgtctgaatattcggattcagacggcctcggatattaatgcggcaattcgccgtttgtgattttttgtttgaagtcgcgcgtttcattgacgatgactttcgccatcaataaaagtgcaatcaggttgggcaatgccatcaagccgttgaatgtgtccgaagccagccacaccaaatcaaggctcaacacggtacccagcataacggaagaaacataacccacgcggtacaaaccggcaaatttctcgccgaaaacatacaccgcgcatttttcgccgtaatagcaccagcccaaaatggttgagtaggcaaagaaaatcaggccgatggtaacaatccagccgccgatgccgggcagcattttttggaatgtgacggttgtcagtgccgcgccgctcacttcaggtttgacaaactcgccgcccgcgccgagcagtcccattaccaacacgatgccggtaatcgagcaaacgacgatggtatccaaaaacgtaccggtcatagaaaccaaggcctgacggacgggatggtcggttttcgcggctgcggcggcaataggcgcagaacccatacccgcctcattggagaacacgccgcgcgccacgccgtagcggatgaccgtaccgatagcaccgcccgccactgcctgcgcgctgaacgcatcggagaaaatcagcttgacggcaggcatcagtgcatcggaattaatcgcgataatggaaagaccgcccaacacataaaacaccgccatagcaggcacgatgaaagaagcggctttggcgatgcctttaataccacctaaaacgacaacggcagtcagaacggtcaacgtaatgccggtataggcaggttcgataccgaagctggtttgcaccgcctgtgcaaccgagttggactgcaccgagctgccgataccgaaggaagcgaatgtgccgaacagcgcaaacgcgacggccatccatttccagtttttgcccaagcctttttcgatgtaatacatcgggccgccggacatttcgcctttggaattgttgacgcggtatttcaccgccaacacgccttcgccgtatttggtggccatgccgaaaatggcggtcatccacatccaaaataccgcgcccgggccgccggttaccaccgcagtcgccacgccggcgatgttacccgtgccgatggtggcggacagcgcggtcatcaacgccgcaaaatgggaaatatcgccttcgtggccttcgccgcttttatgcttctttggcggcataaacgcctgtttcagcgcataacccaacatcgtgaactgcaaaccttttaataaaacagtcagcaaaatacccgtgccgaccagcagcatcagcatcaaaggtccccaaacccagccgctgacggtttcaaaaaaggctttgggattgtctaaaaacacttgcatggctttctcctttgtctgttttatttttaaaacaccacttttgtagtgtccagtaatttcagcacagaatatccaataagacaatatgttcttttgaaaaatacttttggttttttcgccgaaaacaggacggttcaagttgcggaaattgtttgcaattctttaaaagcagcggcggaggtcacaatgaaatgtccgaatggggatgtggcgggcggcagaaatcatcaatgctgccgactgccatacttctgaaatctacaaaatgatgcatcgatcaaacaatataccgctttaaaaaaaccgatgccgtctgaaacgctttcggggtttcagacggcatcaaaagggtacggtcagcggatgatgccgcgcgccgattgtgcgaaaaagtctcggaatacggcaagctcggcttgggtttcggcgcggcggagaatgtctgccttggcttcttcaaacggaatgccgcgatggtagagggttttgtacacgtctttgacggcggaaatctgctctgcggtaaaaccgttgcggcgcatgccttcgctgttgagccccgccggttcggcgcggtagcccgatgccataaagtagggcggcacgtctttgtgtacgcctgcggcaaacgcggtcatggcgtagtcgccgatgcggcagaattggaaaaccagcgtgtagccgcccaaaacgacgtagtcgccgatggtaacgtgtccggcaagcgaggcgttgttggcgaaaatggtgtggttgccgatgacgcagtcgtgcgcgaggtggcagtacgccataatccagttgtcgtcgccgatacgggtttcgccgatgccggttaccgtacctaaattaaaggtggtgaattcgcggatggtgttgccgttgccgataatcagcttggtcggctcgtcgcggtattttttgtcctgcgggatttcgccgaggctggcaaattggaaaatgcggttgttttcgccgatgctggtgtggccgttgatgacggcgtgcggaccgatttcggtattcgcgccgatttggacgttggggccgataacggtgtacgcgccgactttgacgccggagtcgagttcggctttggggtcgatgacggcggtcgggtggatgagggtcatgtttttcctttcctgtcgtgttgccgcgaagatgcgcgacggcaacaggttgtctgaaaactttcagacgacctttttctgaacactcaaaccacgcgtttggcacacatgatgatggcttcgacggcaacttgcccgtccactttggcaacggcgttgaatttgccgatgccgcgccggctggtcagcagctcgacttcaaagacgagttggtcgccggggatgacttggcgtttgaaacgggcttcgtctatgccggcgaagaagaagaattcgttttctttgcgcccgccttcgctcaaaatcgccaacgtgccgcacgcctgcgccatcgcttcgatgatgagtacgccgggcatcacgggcaggtcggggaaatggccttggaactggggttcgtttatggtgacgtttttaatcgcggtcagggttttcatcggctcgaaggcggtgatgcggtcgagctggagaaacggatagcggtgggggatgagtttttggatgtctttggcttcgatggggagttgtacgtccatgtctgtcgtattccttgaataaagtcggtttggttatttgctgtcttgaccggcatctgaaagctgctgctccagtgttttgagccgtttgttcatttcgcttaagcggtggatgtaaacagcgttgcgcgcccattctttatgggtggacatcgggaagatgccggcgaggtgtttgccgctttcggtaatgctgtgggtgacggacgtgccgccgccgatggtggttttgtcggcgatttcgatgtgtccgaccgtaccgacgccgccgccgatgatgcagtagctgcctatggttacgctacctgagatgccggttttggcggcgatgacggtgtgcgaaccgattttgcagttgtgtccgatttggacttggttgtcgattttggtgccgttgccgacggtggtgtcgctcatcgcgccgcggtcgatgttggtgttcgagccgatttctacgtcgtcgcccagcgttaccgcgccggtttgcgggattttgaaccacgaatcgtcggcgaaggcgagtccgaaaccgtccgcgccgatgaccgcgccgctgtggatttcgacgcgtctgcccagtgtgcagccgtaataaacgacggcgttgggatgcaggacgacttcgtcgcccagtttgcaatcgtgttggacgacggcgtttgccaagatgcggcagccttcgccgagcacggtgtttgcgccgatgtagacgttcgcgccgatttcgcagctggtgggaacggtcgcgcccggttcgacgacggcggtcggatggatgccgccgcgcgctttgacgacgggtgaaaacaggcgggcgactttggcgaaatagagataggggtcgtcggcgacaatcaggttgcgcccttcaaatccgtctgccgctttggcggaaacgatgaccgcgcccgcgctgctgtcgtggacttcggctttgtatttcggattggcaaggaagctgatgtgttccgcctgcgcgtctgcgagcgggcgcacggcggtaacggaaatgtcctcgccgcgccattcgccgccgagccgcgcggtgatttgggacagggtgtaggtggccggaatcatggttttcctgttcggtatgccgtctgaaagggtcagcgggcgttcatttctttaatgacgctgtcggtaacgtcgtattgggtgttgacgtaaatcacgttctgcaaaatgacatcgtaaccttcctgtttggcgattttgacgatgacgcggttggcgttttgctggagggaggcaaactcttcgttgcggcggaggttgtagtcttcttcaaactgcgcctgttttttgcggaacgctgcgaccagcccgcgccatttttcttcggcttgcgccttttttgcgtttctgagtttgccttcggcaagctgcctttccaaatccagaccttcgcgttgcagtttttgcaattcgtcctgacgagcggaaaattcgctgtccagcgttttttgaatcttgcgcgcctgcttggattcgaggtagatgcgctcggtgttgataaagccgattttttggaaggtgtcggcgtgcgcgcctgcggtgcagcacaaaccgatcagagccgcggcaaacgcgcgggtcaaacgggtcatggtaaaactccttcgaatgttgccgcgaaatgccgtctgaagggcttcagacggcatttgcgggattagaacgtcgtgccgagttggaattggaagcgttggatttcgtcttccggttttttcttcagcgggtaggcgtagctgaatttcatcgggcctaaaggcgagagccaggtaaccgcgccgccggcggaatagcgcaattcgttggtaaaggtggatttatgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatagactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgctcagggggaagaaccaggtttggttgtgggtggcggagtagtattgcagtttgctgccaggcagggcgatttcggcgttcacgcccgtcaggtagccgcgcgtcggccataacgcgctgtcggttttgttgcgcccccagccgacggtacctttgtacagccagcctttgaagctgccgtctgtgccgtcggttttgccgtatttcttgataaagtcggcatagtgtttgggcgctttgttgtaggtgttgacggtcaggtgttctgccaccaaaccgaaattcacgcggtcgtattcggtaacaggcacgctcatgcggatgcctgcgcctgccgtggtggttttatattgtttgatgctggtcgatgctttgcgcgggtcgaaggcttttccgtaaacatcgtagcccaggctgaccccgtctgccgtgaagtacgggtcagtaaacgacagcgagccgttaagcgtggttttgctcctggaggcgcgcagtgcggccgacttgcccgtaccgaacaggttgtcttgggaaacgcctgcggacatgaccaacccggtatcttgaacccaacccgcgctcaaatccagggaaccggtggaacgttcggtcagactcatgttcaaatcgactttgtcgggcgtgccggcaagcgggacagcatcaaactggacattgtcgaagtagcccaaaagctcgacgcgctctttggaacgttgcagcttggaggtgtcgtaaggtgcggattccatttggcgtaattcacggcggacgacttcgtcgcgggttttgttgttgccggtgatgtgtatttcgttgacgtagattttccggcccggttcgatgtgcaggacgaaatcgacggttttggtttcagcgttcggcagcggctgtacgctgatttcgctgtatgcgtagcctgccgagcccatgcggttctgaatctcacccaaaacggcggtcatctgctggcgttcgtaccatttgccgggcttcatggtcagcagtttttccagttcggctttggggacttcgttggtgtcgccttcgatggagactttgccccaacggaaacgtccgccttcgtggacggtgattttgatggtctgcttggttttgtcttcgttggtttggatgtcggtatcgaggatacggaaatcgaagtagccgttattttggtagaagtcggttactttttccatatcttgggcaaatttctgctcgttgaattggttgcttcgtgtcagccatgtccaaatgccgccttcggtcagggacatttgccgcatcagtttgcggtcggaatagacttggttgccttcaaattcgatgtcggtgattttggcggatttgccctcgtcaatcgtgatgtcgatgtcgacgcggttgcgggcgagtttggttactttgggcgtgatttggatattgagtttgccgcgcccgaggtattcttctttcaggccggcgactgcctgattgagtgtcgcctgattaaagtattgcgactgcgccagcccgaacgattcgaggtttttcttaatggcgtcgttttgcagcatttttgcgccggtgatgttgagcgagccgatggtggggcgttcgataacggtcagcaggagctgcccgtccgcagtttcgacgcgtacgtcgtcaaagaaaccggtggcgtacaggcttttgatgatggcactgccgtgtgtgtcgttgtaggtgtcgccgactttgacgggcaggtagttgaatacggtactcggctcggtacgctgcaagccttcgacgcggatgtcttggatggtgaagtcggcaagtgccaaaggcgatatgcccaacatcatcagtgcggaagcaatctgtttcagtttcattgtcagttccttgtggtgcggaatgcggtttcagacggcattccgaaacgtaaaatctaaccgagcagccgggtaacgtcgttgaagaaggcgaccgccatcatcagcatcatgagggcgagcccgaagcgcaaaccgatgttttggacgcgttcgcccaaaggtttgccgcgtatccattcggcagtataaaacacgaggtgcccgccgtccaaaacagggacgggcagtaggttcagcacgccgaggctgatgctgaccagtgctaaaaattccaaataactttgcaagccgagttcggcggactgtccggcaatgtcggcaatggtcagcggcccggaaatatggctgacggaggcgttgccgctgattagtttgccgaaaaatttgagggttgtccacgagtgggaaacggttttttcccagcccatgccgaatgcgcggacaacagacggacggtagctgcggcggatttgcgcgtcccacgccctgtccggctgcggacggaggccgacgcgcccgatcagggtgtggtcggactgttcgacagtatcggggcggatgtcggcggtatgggtttgtccggcgcgttcgtagttcagggtgatttttttgccggggctttggcgggtcaggtttgcccattcttgccatgaggcgatgggtttgccgtcggcggcagtcagcctgtcgcccggtttcaggcctgctttttcggcggggctgcctttttccacgccgccggcaacggttgtgattttaaagggcatcagtccgatgtagccttggttttttgcgattttaccggcttccggcgtgcctgcggcatcgatggtgcggacggtttgcgcgcccgatgccgtctgaacgccgacggcgactttgccggcttcgaggttgaggacgatttcggtttgcgcgctgccccaatctgcaacgggtgtgccgttgacggattgtattttgtcgccgctttggaagccggcgcgggcggcaatggtgtcgggttcgactgtgccgacgtaggggcgcagttcggttacgccgaaggaaaagctcagtccgtacagcaaaaccgccagtgcgaggttggtcagtgggccggcggcgacgatggcgatgcgcttggcggggtgttgtttgtcaaaagcgtagggtaaatcggcttctgatacttcgccttcgcgcgtatcgaccattttgacgtaaccgcccaacggaatcggggcgaggcaccattcggtgtcgccgcgctttcgggtgaaaaacggtttgccgaagccgacggaaaagcgtacgactttgacgccgcacaatctggcaacgatgtagtgtccgaactcgtgcaggctgaccaaaatcaggatggcgaagataaaagctagaagggtgtgcaaatggttttcctttgataacggtgttcagatggcatcagcgcagtgtgccgataaatgctcgcgcttgtgcgcgtgtccgggcatcttgcgccaagagcccccctatatcgcctatgccgtctgaaaagtcttgtgcaagacagtgggcgacggttttggcaatgtcggtaaacttaatctgtccgtccaaaaaggcggcgacggcggcttcgttggcggcgttcaatacgcagggcgcggctccgcctgcgttcatggcttcataggcgagcctcaggcaggggaagcggtcaaagtcgggcttttggaaggtcagcgcggacaatgcgtcgaaatccaggtcgccgacacccgaatcgatgcgctcgggcaaacccaaacaataagcgatgggcgttcgcatatcgggattgcccagttgcgccagcacggagccgtcgcggtagcgcaccatgctgtgtatcacggattgcggatggatgacgacttcgagtttgtcgggcggacagttgaacagccaatgcgcttcaatcagctccaaacctttgttcatcatggtggcggaatcgacggagattttgcgtcccatacgccaattggggtgtttgaccgcttgggcgggcgtaatgcggtcgaacgtgtttaaatcggcggtcagaaacgggccgccggaagcggtcaggataatcgaagcgatgccgtgttcgttcagacggccggcgtaatcgcgcggcaaaacttggaaaacggcgttgtgttcgctgtcgacgggcagcactgccgcgccgtttgcacgggcggtttccataaacaacgcgccggaaaccaccagcgtttctttgtttgccagataaatggttttgcctttttgcgccgctgcgagcgcggaaggcagccccaccgccccgacgatggcgcacatgacaccgctgacttcgtcggcagaggcaacgtcaaccaatgcctgcgcgccgtgtaaaacctgagtcgccgtgccgtcgcgtttcaacagggcttcaagccgggcggcgtgttccgcatcggcaacgacggcatattcggggtggaacgtttgacattgagccgccaatttctcgacctgcttatgccctgccagcgcgaatacgcggaatttttcggggtggcgggagacaacgtccagcgtgctttcgcctatgctgccggtactgcctaatatggtcaggacttgtggtgtcataatggggataactttataccggatgccgtctgaagcgttttcagacggcatagaatcaatttaaaaccgacatcatcgctgcatagacgctgataacggcaatcaggctgtcggtacggtcgaacacgccgccgtgtccgggcagcagcttgctgctgtctttgatgcctgccgcgcgcttgagccagctttccaaaaggtcgccgcatacgctgacaacggtcagcaccaaaccgattaacacggtatcgaaccagcctgtatcgaatgccagccagccggcacttcgtacggcggtcatgtacactgccacgcaaaccgcgccgccgattgcaccttcccagcttttgccggggctgattgccggcgcgattttgtgtttgccgaacgccttgccgctgaaatacgcgcaaatatcggcaacccacaccaaacccatcacggcgagcagcggcagggcatcatcgggatgcgggcgcagggatacgagcgcgaaccaaaacggcatgaccagaagccagccgacggcataaacctgccaaccgccgttgagcctccatttgaatctcaaccataaaggcataacggcgagccaaaatgccaaaacaacataccaaaccaaattaggcagcatccagccgcccgcataggcaaccacgccgaaaaccaaggttgcggcgaggtaatggttggttttaattttgcacaaaccgcccatacgggcatattcccacaaggcaatcagggcaatcagtccgcaaaatgcagcccacaaccattgcggcgcgtaaaacagcatgcccagcatcagcggcagcagccacatggcggttattacccgttgtttcagcatattcagttcctttgctgttcgataggcagttgctcggaggtgcgtccgaaccgccgttcgcgtttttggaacgaagcgacggcatcgtccaaagccttgccgtcaaaatcgggccacaaaatatcggtgaaatacagttctgcatatgccatctgccagagcaggaaattgctgatgcgcgtttcgccgccggtgcggatgaacaaatccggttccggtgcatcgcccagcatcaagtgtttcgccagcgtgtcttccgtaatctcggatacgccttcggcaatcagtttgtttgccgcctgcaaaatatcccagcggccgccgtaatcggcggcaatgctcagggtcaggccggtattgtttgccgtcaacgcttccgcctcttcgatgccttgcagaatctgccggttgaagcgttcgcggctgcccaatatcttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatagagacgcggccttcttccgcttcgccgcgtacgactttaatcaggtctttgcggcgttcctcggtcagcatgggcatcggcacgcggatcaggtcgccgacagctgccgggttcagtcccaagtttgaatcgcggatggctttctcgactttggccgccatattgccctcaaacggtttcacgccgatggtgcgcgcgtccagaagcgttacgttggcaacttggctgacggggaccatgctgccccagtattcgacttccacttggtcgagcaggccggtatgcgcgcggccggtacgcactttcgccagattttctttcagtacttcgaccgaacgctgcatcttgccttcggctgttttttgaatatcgttgatcatattgttctttcggtgggataaggtgggcgggagaccgtctgaacgcgtttcaagccgttcagacggcataaagaccgttaaccgcgaatagtaccgttattcgggcataacgacaaggtaggcggattggggatgccgtctgaagcgacaggcgtttcagacggcatcgtgtccgaccgtcagccgtgttcccgtgtttcaagcaggctttggcgcaggtgttggcgttcgtgggcatccagccatttgcggcgggtgcgttgcagcaggatgacgagggcggaaatttcctgacgcatattggtgctgagccagaggaagccctgccattggtagtggaggtgttcggcgagggcttccagttcggggttgatggcggtgtcgatgcggatgcggcgggcgtgtctgccgttgataagggcgacggtttgttgcaggtcggtttggagcagtgtgaagtggcggtcaagcagccggatttcgctgccgttgagtttgggagattgcagcttggcggcggtggtcaggagcagctcggtggtgttgacgattttacggtgggcgtgctgcatggcttccatcatggcggggctgatgcggctttcgcccgatgtggcggcgagatggctgcggcttttgaccatgcgtgcgttgatttggcgcattttcgccatgttctcctcgaggcgttcgcgggtcatgcgcctgccgttgctgatttcggcaatcattttgctgcagtcggccaggttgtcggcaagcatgaaacgccacatcagtgtggatttcagcggcagcagtttggcggcggcgatggcgatggccgcgccgatgaggacgttcatggcgcgcatgagtccgctgtcgagccattcgctgccgttgtcgccgatgagcatacacatcgtcagccctgccagcatagggacgtagccgtttttgccgaccgccgcccagccggccagtgcgcttgccgtgccgacggtgaggtagaagaggaggttgccgtggaaataatgctggttcagccataaaacgcccaaacccgcgcccagcccgatgaccgtgccgagcatacgttccaccgccttggagtaaatcgccccttgaaactggagcatgccgaggacgacgaagacggtcatccctatccactcgccgtgttggaggtggagcagccgggcggaggcggtggcgaacaggacggccccgccgagccggacggcgtggatgaggcggcggtagcggtagcgttcgtaggagttgagccagcggctgacgaggcggttgcgttgcgaggtgttcatatcggttgtgccgtctgaagcggaaatgtgaaaaagcacaggcttcccgaggaagggagggtctgtgcttggtattggtgccggagaagggaatcgaacccccgaccttcgcgttacgaatgcgctgctctaccgactgagctacaccggcgttttttcgtcatgatatatatgaacggttgtttgtgcaacttttcgggcgggcggcaaggcagtgcgcggtatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccgctatataatgcggtctgcttcggaagagggggacggcgatgtttgtgaacgagaaatatccttatgcggctctgtttgcgggactggtgtttttgacgctgccgtttgcgttggcggtgcatgatgcctttgcgcttgcgttcggacggacggggttgctggtgtcggtgtcggacggcggattcggctggcgtggcggttgggacggcactgtttggtttgtgttcggtgtgtttgcgtttttgaatgtggttgtgtcggcgggtctgacgaaactggcgtacaaaaagatgatgcggcggcattcgcgttacacactgtttctgtcgggcgtggcggcttgcgcggcggcagcggtggcttggattttcgagctgctgcttggcagtggggctttgggcgggctgcgggggaggcggtgttggaatatgcgtttgccgtgtggctggtggcgatgctgacgctgcccaaacgcctgacgcgcgcgccggtgcagccggtggtgtttcacaggaaaaaataggttggaacgggaaatgccgtctgaaacccgacacgcggtttcagacggcatgtttttccgctaacattacgcctgaatatggacaggaagcagatatggaacgcaaagaacgcctgcgtgcaggcattgccgcgatggggctggatatttcggaaacggcgcaggacaggcttttggtctatgtggatttgttgaaaaagtggaacaaaacctacaatctgaccgccctgcgcgacgaggaaaaaatgattgtccatcatcttttggacagcctgacgctgctgccccatatcgagggtgtgcaaacgatgctggatgtcggttcgggcggcggtcagcccggcattccggcggcggtgtgccgtccggatgtgcaaataacccttttggatgcgaatacgaagaaaacggcttttttacagcaggcggttatcgagttggggttggacaatgtgcgcgtggtatccggacgcgtggaggcggtttcggacgtgcgtgccgatgtggttaccagccgtgcgtttgcagaactggcggattttgtgtcgtggacggtgcatctgttgaaagacggcggctactgggcggcgatgaagggcgtgtatccgcaggaagaaatcggccgcctgccgcaggatgtgtgcgttgaaaaagtccaaaggctcgacgtgccgggcttggatgcggaacgccatatcgtcatcctgagcaagcgttgagcgcacttcagacggcatgaataccttttttgtgcggataaaggtaaaattccgcactgtttttcttttttcaacatcagacgggacacgggcgggacatgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgggtttgcagtccggcgtttatcaggtcttattgggcgatgcggacgtgcagtcggcggcggtacgcagcaaagagggcggatacgctgtgttgggtgcgaaccgcgcgctggccggcgcggaaatcgaactggtgcaggaaatcgcccgggaagtgcgtttgaaaaacgcgctcaaggcagtggaagaagattacgactttatcctgatcgactgcccgccttcgctgacgctgttgacgcttaacgggctggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgcacgatgtacgacagccgcagcaggctggttgccgaagtcagcgaacagttgcgcagccatttcggggatttgctttttgaaaccgtcatcccgcgcaatatccgccttgcggaagcgccgagccacggtatgccggtgatggcttacgacgcgcaggcaaagggtaccaaggcgtatcttgccttggcggacgagctggcggcgagggtgtcggggaaataggtcaatccaaatcgggctgcccgtgcctttatgctgtttggccgggtgcgttatagtggattaacaaaaatcaggacaaggcgacgaagccgcagacagtgcaaatagtacggaaccgattcacttggtgcttcagcaccttagagaatcgttctctttgagctaaggcgaggcaacgccgtactggtttttgttaatccactataatatggcggattaaaataaaaatacttatatcgtcatttatcgtcattcccgcaaaaacaaaaaaatcaaaaacacaaaactgaaatatcgtcattcccgcgcaggcgggaatctaggtctgtcggtacggaaacttatcgggaaaaacggtttttccaaccctgagactccggattcctgttttcgcgggaatccggttttttgagtttcagtcatttttgataaattcttgcagctttgagtttctagattcccgcttttgcgggaatgacgcggaaaagttgctgtgatttcggataaattttcgtcacgcttaatttctgttttatccgataaatgcctgcaatctaaaatttcgtcattcccgcaaaaacaaaaaatcaaaacagaagcctaaaatttcgtcattcccgcgaaggcgggaatctaggtctgtcggtacggaaacttatcgggaaaaacggtttttccaaacctgagactccggattcctgttttcgcgggaatccggttttttgagtttcagtcatttttgataaattcttgcagctttgagtttctagattcccgcttttgcgggaatgacgcggaaaagttgctgtgatttcggataaattttcgtcacgcttaatttctgttttatccgataaatgcctgcaatctaaaatttcgtcattcccgcgaaggcgggaatctaggtctgtcggtacggaaacttatcgggtaaaacggttttgccagccctgagactccggattcctgttttcgtaggaatccggttttttgagcttcagtcatttttgataaattcttgcagctttgagtttctagattcccgctttcgcgggaatgacggtttggaagttacctgaaattcaaaaaaaaaacggaaaccggacggattggattcccgcctgcgcgggaatgacggattttaggttttttttttgattttctatttttcgcgggaatgacggtttgggttctttctctttggagttgcgatgccggaaatgccgtctgaaggcttcagacggcatttttgtgccggtttaaaacaaggcctgctgcgcgagcaggtttctgacgggggcgaagtcgcggcggtgttcgggcagcacgccgtatttttcgagggcttccaaatgctgcttcgtgccgtaacctttgtgtttgtcgaaaccgtattggggatggcgttgcgccagtgcgtacatttccgcatcgcgtgcggtctttgccaaaacggatgcggcggagatttcgatgattttgctgtcgcctttgacgacggcttcggcagggatgttcaaatgttcaggaatgcggttgccgtcgatgaatattttttcgggacgcacagccaagccgtcaacggcgcgtttcatcgcgagcatggtggcgtgcaggatgttgaggctggcgatttcttcgggcgaggcggcggcaacgtgccactcaaccgcctgattttttatcatttcggcaagcgcgtcgcgttttttctcgctgagttttttggagtcggtcagtccgggcaggtcgaatgtttccggaaggatgacggcggcggcaaacacgctgccgactaaaggtccgcgtcctgcctcgtccacgccggcggtcagtatgtgcatgatgtttcctgtcgggatggtgggaatgccgtctgaaaagggtttcagacggcatcgcgccgatgtgtttatttcgcgtctttaaacccgcgcttcaaatgcaccatcagcaatgccactgccgcaggggttacgccggaaatgcggctggcttgtccgacggtttcgggtttgtgctggttgagcttttgctgcacttctgccgacaagcctttgactttgccgtaatcgatgccgtcgggcagttttaaggtttcgatgtcgcggcggctgtcgatttcttcgttttggcggtcgatatagccttggtatttgacttggatttcgacttgttcgatgacttcggcggagaggttttcagacggcatcgcgccttcgagcgtcatcagcgcggcgtagtcgaggtttgggcggcgcaggaggtcgtgcaggttggcttcgcggctgagtttttgtccgaacacacggatttgttcgccttcggcgagtttttgcggcgtgtaccacgttgttttcaaacgttggatttcgcgttcgacggcttcgcgtttttcgttgaacatgcgccattgcgcttcggacaccaagccgattttgtagccgtcttcggtcaggcgcatgtcggcgttgtcttccctgagttgcaggcggtattcggcgcggctggtgaacattcggtagggttcgttcacgcctttggtgatgaggtcgtccaccaatacgccgaggtaggcttgttcgcggcgcagcaggagcgggtcttgtccgcgcacatattgcacggcgttcgcgcctgccaataaaccttgcgcggcggcttcttcgtagccggtcgtaccgttgatttgcccggcgaaaaacaatccggcaatggttttggtttcgaggcttgctttgaggttgcgcggatcgaagtagtcgtattcgatggcgtagccggggcgcaggatatgggcgttttccaaacctttcatactgcggacgagcgcgatttggatgtcgaacggcaggctggtggagataccgttaggatagtattcgtgcgtggtcagaccttcgggttcgaggaaaatctggtggctgtctttgtcggcgaagcggttgattttgtcttcgatagacggacaataacgcggacccacgccttcgattttgccggtaaacatcgggctgcggtcgaagcctgagcggatgatgtcgtgggtttgcgtgttggtatgcgtaatccagcaggacacttggcgcgggtgcatatcggcgttgccgcgcacggacatgacgggaacgggcgtgtcgccgggctgttcggtcagttgggagaagtcaatcgtgcgtccgtcaatacgcggcggcgtgccggttttcagacggccttgcggcagcttcaattcgcgcaaacgtccgcccaacgatttggcggcggggtcgccggcgcgtccgccttcgtagttttccaaaccgatgtggattttgccggacaaaaacgtgcctgcggtcaacacgacggcgcgtgctttaaactccacgcccatcgcggtaattacgccgctgatgcgttcgccgtcgagcgttacgtcttcgacggcttgttggaaaaggtcgaggttttcttggttttccaacatttcgcggatggcggctttgtacaggatgcggtccgcctgcgcgcgcgtggcacgcactgccgcgcctttgctggcgttcaggcggcggaactggataccggatttgtcggttgccaacgccatcgcgccgccgagcgcgtcgagttcgcgcaccaaatgccctttgccgatgccgccgatagaggggttgcacgacatttgtccgagcgtttcgatattgtgtgagagcaaaagcgtctgcgcgcccatacgggcggcggcgagtgcggcttccgtgccggcgtgtccgccgccgacgacgataacgtcgtaggttttggggtaaatcatgtgggtcatagtgtgtattgcctgacggtgtttcagacggcatttatagtggattaacaaaaaccagtacagcgttgcctcgccttagctcaaagagaacgattctctaaggtgctgaagcaccaagtgaatcggtttcgtactgcttgtactgtctgcggcttcgtcgccttgtcctgatttttgttaaaccactatattcaatatgccgtctgaaaaacgaaatggattcaaaagtaaagggttgggattgtacgcttgttcgccctgtttttacagtgtgcggaaagggaaaagccgcttcgcggggaagcggctccggtaagggcgggatttaccaaacgtcggatttgatacggcgtttcaggcccggatgttcggaaagtttgaactcggggtctttgcccattttcagcttggcggtgtaatcgcgcagcagcataaacgccaagggcgagagcagcaggatggcgacaaggttgatccacgccataatgcccatcgccatatccgccatatcccagaccaaaggcacattggcaaccgcgccgaaatagacccacgccaaaaccagcatacggaaaacggcggtaatcagccaatggcttttgatgaattggacgttggactcggcataggcatagttgccgataacggtggaaaaggcaaacataaacaggatgacggcgaggaagcccgcgccccattgccccacttggctgacaatcgccgcctgcgtcagcgccgcaccgctcaaatcgccgtaaggctgttggtaaatcaagatgatgaaggcggtgcaagaacaaacgatgatggtatcgacaaacacgcccagcatttgaatcataccttgcgaaacagggtgtttcacttcggcggcggcggcggcgttcggcgcggaacccatacccgcctcgttggaatacaggccgcgtttgatgcccatcatcatcgtttgcgaaatcagaccgccgagtaagccgcctgctgccgcgtcgaatttgaacgcgcccgaaaaaatctgaccgaacacgtccggaatcatcggaatattggtcaaaatgatgaaaagcgcgataaagaggtacaaaaccgccatcagggggacgacgatttccgccgctttagatatgcgcctgatgccgccgaagataatcggcgcggttaaaatcaccagggcgacgccgacataatgaggctcccaaccccatgccgctttgacggtatcggcgatggtattggtctgaaccgcttcaaacacaaagccgaaacagaaaatcaggctcagggcgaacaacacgcccagccatttctgccccagcccttgagtgatgtagtaggcagggccgccccggaaatggtggttgtcgtagtcgcggactttaaagagctgcgccagcgaagattcgacaaacgccgaactcataccgattaaggcggttacccacatccaaaacaccgcgcccggtccgccgactttgatggcgatggccacgcccgcgatattgcccacgcccacgcggctggcaaggccggttacaaatgcctgaaacggcgtgatgccgtgagggtcgtccccctgtttgcggccgccgagcatttctttgatgctgcgcccgaacaggcggaattggacaaagcccgtggttacggtgaagaaaagccccgtacccaaaagcatataaaccaagtatgaccacatcggatcgttgatggcgccgacccagccgtgcagccattcggtaaagttctcgttcatatcgcttccttaaagttgaaactcgcacatattggcggtatgcaagcagggtttaaattttgtaaacgcccattctagcagattgtcaacaaaatcagaaaaatttacatcgccgcgcggctgcggcgttagaatcgcattttgtttggagcaaacacgatgaaacagcctgtttttgccgttacttccggcgagcctgccggcatcggccccgatatttgtttggacttggcgtttgcacgcctgccctgccgctgcgcggtattgggcgacaaaaacctattgcgcgcgcgcgccgaagccttgggcaaaagcgtcgtcctgcgcgacttcgatccagaatcaggcggcgcggcatacggcgagctggaagtgctgcacatccctgccgtcgaagcggttgaggcgggcaaactcaatcccgccaacgccgcctatgtgctgcaacttttggacaccgcgctcgcaggcatttcagacggcattttcgacggcatcgttaccgcgccgctgcacaaaggcatcatcaacgacgcgcgcgcaagcacaggttttttcagcggacacaccgaatatctggcggaaaaaagcggcacggggcaggtcgtgatgatgcttgccggcaaaggcctgcgcgtcgccctcgtaacgacccacctgccgctgaaagacgttgccgccgccatcacgcaaccgctgattgaaagcgtcgcacgcattttgcatcacgacttaaaacacaaattcggcatcaaaaatcccaaaatccttgtcgcckgacttaatccccacgccggcgaaggcggacacctcggacacgaagaaaccgacaccattatccctgcattggaaaacctgcgccgcgaagggataaaccttgccggcccgtatccggcggacacattgttccagccgtttatgctcgaaggtgcggatgccgtattggcgatgtaccacgaccaagggctgcccgtgttgaaataccacagcttcggacagggcgtgaacatcacgctcggcctgccctttatccgcacctccgtcgatcacggcaccgcgcttgatttggcggcaaccggcagggcggattccggcagcctgataactgccgtggagaccgccgtcgagatggcgcgcggcagcctttaaagatgataaaagacccgtcatttccgcgcaggcgggaatccggtctgttcggtttcagttgtttttgggtttcgggtaatttccaaatcgtcattcccgcgcaggcgggaatccagaccattggacagcggcaatattcaaagattatccgaaagtttgaggttctagattcccgttttcacgggaatgacgaaaggtggcgggaatccggtctgttcggtttcggtttttttttttgaggtttcgggcaacttctaaaccgtcattcccgcgcaggcgggaatccagaccattggacagcggcaatattcaaagattatctgaaagtttgaggttctagattcccgttttcacgggaatgacggaatgttgcgggaatccggcttgttcggtttcggtttttttgaggtttcgggcaacttctaaaccgtcattcccgcgcaggcgggaatccagaccattggacagcggcaatattcaaagattatctgaaagtttagaggttctagattcccgttttcacgggaatgacggaatgttgcgggaatccggcttgttcggtttcggttttttttgaggtttcgggcaacttctaaaccgtcattcccgcgcaggcgggaatccaggcctttgggcgacggcaatattcaaagattatctgaaagtttagaggttctagattcccgttttcacggaaatgacgaaatgttgtgggaatccagaccttcgggcagcggcaatattcaaaggttatctgaaagtttgaggttctagattcccgttttcacgggaatgacgaaaggttgtgggaatccagaccttcgggcagcggcaatattcaaagattatccgaaagtttgaggttctagattcccgttttcacgggaatgacgaaaggtggcgggaatgacgaaaggttgcggtaatcatgggaatggcgaagtttcagacggcatcgtccaccctccgccgtcattcccgcgcaggcgggaatccaggcctttgggcgacggcaatattcaaagattatccgaaagtttgaggttctagattcccgttttcacgggaatgacggaatgttgcgggaatcatgggaatgacggaatgttgcgggaatcatgggaatgacggaatgttgcgggaatcatgggaatgacggaatgttgcgggaatcatgggaatggcggaatgtttcggtaatcacgggaatggcgaagtttcagacggcattgcaggtatccgaacccatgtaaaaaagaggttctgcggaacagaacctctttttgccgccgtcggttcagccttgccgggtttcgacttggatcatttcttcggcagggacggttgcgacttcagacggcttgggctgttcggaacggcgcaaaccgcgtccggcttggacttcgggttgtgccgcccatgccttcaatgcggcagggtcggtttcgatcaggacgagtccgccggtttgtgcggtttcccgtgcctgttccgccgcagccgtaaaggttgcggtttcagacggcatttcctgtgcttcggctttcggtgtcgcgccttcgggcaggatggcggcggtggcacggcggattttttccgccgcatcataaaccggtgcgtcgccgtttgaaacggcgggagatgctgtcggaagatccctttctgcaaccggatcggcaatgctgacagtaatcggcgcgtttgcgtcggtttcgccgaaaacgtgcgcggcggcggaacggactttgtcggcggtgtcgtgaatattcaggtactgctcgattttggcggcagacggaatattgcgttttttgccgttttgacggcggtcgcgctgattgttgcgctcgcggcgttctttggcatctcggctgtcgcgttcgcggcggttgcgttcggatttgggcttgctgcctttgtcttctgcggtatgcggttcggacggcgtgttttccgctgtctgaacggttgtttcggcaacggtggcggtttccggcgcggtttggccgcgttcgctgcggctgccgttgcggcggcgttttccggtttgcacttcggtttcggacggtgcggcatctgcaacggttgcggcaggctgtacgttgcggctttggatttccgcttcgttggcgcgttcggcggcacggtcgccgcgttcattgcggcggcggttgccgttgttgcgcgtttcggctttgtcggcacgcgcttcctgtccggcagttttgcctgccacttcgcggacttctactttgctgccttcgcgtttgctgcggcgcgggttttggcggcggttgttggcgcggctgccgctgcggtttgccgtgctgcgtttttcggaggtttcggcagcgggcgcggcttgggtttcgctgccgccgaaaatgcgtttgagccatgctttgaagctgtcccaccaagaggtttttttctcgggggcggcagtcggggcggggctggtgtggcgcacgcctttgacggcgggttcgggacgggcggctttggctttttcgccgccgaacggtttggcggattcgtcttcttccggctcggcgacgcgtttgtagctcggttcgccgtcttcttctacgtcgtcggtgcggatgcggttgatttcgtagtgcggattttcgaggtggatgttcggaatcaggacgacgttgacatccaaacgctcttccatcgcaaacagctcggcgcgtttttcgttcagcaggaaggtggcgacatcgacgggcacttgtgcgcgcacttctccggtgttgtccttcatcgcttcttcttgaatgatgcgtaaaacgtgcagggcggtggattcgatgccccgaatcacgccggtgccggcgcagcgcggacaggcgacgtggctgctttcgcccaaagccggtttcaaacgttggcggctcaattctaaaagtccgaaacgggagagtttgcccatctgcacgcgggcgcggtcttttttgagcgcgtcgcgcaggacgttttccacatcgcgctggtgtttggggttttccatgtcgatgaagtcgatgacgaccaagccgcccaagtcgcgcaggcgcatttgtcgggcgacttcttcggcggcttccatattggttttgaacgcggtgtcttcaatgtctgcgccgcgagtggcgcgtgcggagttcacgtcgatggagacgagggcttcggtatggtcgatgacgatcgcgccgccggagggcaggctgacgctgcgcgaaaacgcgctttcgatttggtgttcgatttggaagcgggaaaacagcggcgtgtggtcttcgtagagtttcagacggcctatattgcccggcatgacgtagctcatgaactcggcaacttggtcgtaaacttcttgattgtccaccaaaatctcgccgatgtcggggcggaaatagtcgcggatggctcggatcagcagcgagctttccataaagagcaggtaggggtcgtgatgcgcttttcctgcttcttcaatcgcctgccagagttgtttgaggtagttcaagtcccattccaactcttccgcgctgcggccgatgccggcggtacgggcgatgatgctcatgccgttcggaatgtcgagttccgccatggcggctttcaactcttgacgctcttcaccttcgatacggcgggatacgccgccgccgcgcgggttgttcggcatcaataccagatagcgtccggcgaggctgatgaaggtggtcagcgcggcgcctttgttgccgcgctcgtctttttcgacttggacgatgacttccatgccttctttgagcacgtcttggatgcgcgcgcgtccgccttcgtagtcttggaagtatgagcgggagacttctttaaacggcaagaagccgtggcggtcggttccgtaatccacgaaacacgcttccagcgacggctcgatgcgggtaatgatgcctttgtagatattgcctttgcgctgttctttgcccagcgtttcgatgtccaaatccagcaggttttgtccgtcgacgatggcaacgcgcagctcttcggcctgcgttgcgttaaataacattcttttcatgatcacctcgtgggcaggcggcgttcagacggcacatgcccggttcggcattccgtaaggctgggttttccgatgttttcggataaaaccggtaatcagtttttgagttgaaaatccgcagggatgcacgttccggagaaccgtgtgcggaagggtcggatacagaaggctataaagatcgatgcggcggtttgtctgccgcgttccgaacgctgcggtcggaaaaatgggggccggcttcttcttgttatcgtgatgcctgtgttttgggcggtttgcgtttgggacttgggcccggctgccgtcttacttccgcgccgaaacggcaaaatcaattcaaacttgattacgttctgcgcctgccggctgggaacaggcgcagggaaaatgctttgcggagtgcgtttttaatataaaattccgttttaaagtaaaccgtttcaggaggcgcggcgggcgcgctttttgctgaaacggatgttcggattatagatgaaaacgcacgaaataagcaaagattcggtcagcttgataggggttgccgaacatgaggcgggtcaacgccttgataactatctgataaaaatcctcaagggtgttcccaagagccatatccaccgcattatccgcgccggcgaggtgcggttgaacaagaaacgctgcaaacccgacagccgtattgcggagggggatacggtgcggattccgcctgtgcgcgtggcggagaaggaaatgccgtctgaaaggcgtgccgccgtaccggcgcgtgcgtttgacgttgtttacgaagacgatgcgcttttggtcatcgacaaaccgtccggcgttgccgtccacggcggcagcggcgtgagtttcggcgttatcgaacagttgcgccgcgcccgtccggaggcgaagtatttggagttggttcatcgtttggacaaggatacgagcggcttgttgatggtggcgaagaaacgcagcgcgctcgtcaaacttcacgaagccatccgtaacgaccaccccaaaaaaatctaccttgcgctgggggtgggcaaactgccggacgacaatttccatgtcaaactgcccctgttcaaatataccggcgcacaaggcgaaaagatggtgcgcgtcagtgcggacgggcagtcggcgcatacggtgttccgtgtgttaagccgtttttcagacggcattttgcacggtgtcgggctgtcgcacctgactttggtgcgggcgacgttgaaaacggggcgcacgcaccaaatccgcgtccacctgcaatctcaaggctgtccgattgcgggcgacgaacgctacggcgattatcaggcgaaccgtcgtttgcagaagttgggtttgaagcggatgtttttgcacgcgtccgagctgcacttgaaccatccgctcacgggcgagccgctggtgttgaaggcggagctgccgccggacttggcgcagtttgcggtgatgttggaaaacgggacgaaaatgtgaaccccgatgccgtctgaagccttcagacggcatcgggacgtgaaagtatgtggggacagacgaatatggctgataaaaaaagccctttgattgccgtcagtgtcggcgaagcgtcgggcgacctattgggggcgcacctgatacgcgccatccgcaagcgttgtccgcaggcgcggtttaccggtatcggcggcgaactgatgaaggcggaaggtttcgagagcctttatgatcaggagcggctggcggtgcgcggctttgtcgaagtggtcaggcggctgccggaaattttacggatacgcagggggctggtacgggatttgctgtcgttgaaacctgatgtctttgtcggtatcgatgcgcccgattttaatttgggtgtggcggaaaagctgaaacggtcggggattccgaccgtgcattatgtcagcccgtcggtgtgggcgtggcggcgggaacgtgtgggcaaaatcgtgcatcaggtcaaccgcgtgttgtgcctgttcccgatggagccgcagctttatctcgatgcgggcggacgtgcggagtttgtcggtcatccgatggcgcagcttatgcccttggaagacgaccgtgaaacggcgcggcaaactttgggcgtggatgccggcatccccgtattcgccctgctgcccggcagccgcgtcagcgaaatcgactatatggcgccggtgttttttcagacggcattattgttgttggaacgctatcccgccgcacgcttcctgctgcctgccgcaacggaggcgacgaagcggcgtttggcggaagttttgcagcggccggagtttgccggattgccgctgacggtaatcgacagacagtctgaaacagtgtgcagggcggcggatgcggtgctggtaacgagcggtacggcaactttggaggtggcgttgtgtaagcgtccgatggtcatcagctacaagatttcgccgctgacctatgcttatgtgaaacgcaaaatcaaagtgccgcatgtcggcctgccgaatatcctgttgggtaaggaggctgtgccggaattattgcaatctgaagcaaaaccggaaaaactggcggcggcgttggcggactggtacgaacaccccgataaggttgccgcgctgcaacaggatttcagggcgttgcacctgctgttgaaaaaagatacggcggatttggccgcgcgcgcggttttggaagaggcgggatgttgagcggttaatggattattttcccgaagcagcacgtattacaaaaaaagggggagaaattgtgattaatggcacatcaaacaataagtatttaagaggaattccaaatgaaacagaactggcccgaatgggattaaggttaaaatataatggtcagttaactgattaattttgttatatatgatttatgattatagcttatactaatacgcttacttaccttgtttcatttgttcttcgtaaatttctattttaggcaattgtgtcagttcaatagggcaagttgctccccaccaaaaatgttctacataaaaccaaggattatctggaaaatatagcaacatctcttccatatccggccaaattcttcttaattcatctacctgtgtttttggcgaaccagttaatatttttggaggattttcacgataatcgcataattcaataacaccatctgataaaagttcttccaaaaaatcaaaaaatctaatttttaaatttggatctttgatatccatatttaaataatttttataaacaccaaaaataccacctaaatattcacaatattctaaaagattatattttatcttcacattcataacgtaacctttatctaaattttaattctaatctttgcccatgtactgaatcaggttgattcctaaactcaatcgtccattttgctccagtttgttctcggctagttgaaaaattccttaaaataaaggaagagtttaaacaactgaaatttcataagagtagtagaaccaacttggactcaaaaaatcttaaactcattgtttttgaaaaggtaaaataatatgacaacttataccattccaaaaaaagattatcaatttctgtatatatatgagggcactctattaaactatactttgaaaaacgatgaattccatatcatcgtccagaatgtggattatccggactttcctcaagagattcctacaccaaattatacagactgggtaaaaattaaattcaagcagttcagctatctgaaatttatctatggatacgccacgaagaaccaagataaaaatatcaaaaatgtattggaacttggagaattaaagcaggatgatgaaatcttggattatggaggtgcgctggaagtgataggcagtaggtatgatcttccgaccggttttagtatagatatagtttgccgggaaatagagttagaatttttagatcaggagagtttcaattaaacgagccgtagcttgttatgctgagcaggcaactttatcgtatttccttttcggttgaaaccccgccactcggacatctgtccttcggggcggtagaatcagattttatttgggaggggcgtaaccccttccgaatcagggcaacacatagggcgacgctttatgtgtcgtcctgtgtgttgaaacattgatatgccgatacggagcctgtcggcaaaatgccgtctgaacaatatcttttcagacggcattttgtatgggggttaacggttgttcagcccgagtacgtcctgcatatcgtacaaacccgttttgccgttgacccaaactgcggcgcggacggcaccggcggcaaaggtcatgcggctgctggccttgtgggtgatttccacgcgctcgccgtcggtggcgaagagggcggtgtggtcgccgacgatgtcgcctgcgcggacggtggcaaagccgatggtcgacggatcgcgcggaccggtgtggccttcgcggccgtaaacggcgcattgtttgaggtctctgccgagcgcgccggcgatgacttcgcccatgcgtaacgcggtgccgctgggggcatcgactttgtggcggtggtggccttcaatgatttcgatgtcgtagccttcgtttaatacgcgtgcgacggtgtcgaggatgtggaaggtgaggttgacgccgacgctgaagttggcggcgaaaacgatgcctgttttttcggcggcagtgtggatagcggctttgcccgtatcgtcgaagcctgttgtgccgatgatgatgttgacttgtttttcaacgcatttttgcaggtgtttgagggtgggctcggggcgggtgaagtcgatgagtacgtcgctttgtgcgagaacggcgtcaacgtcgtctgaaatggcgatgccggttttgagtccgacggcgtagcctgcgtccagcccgagggcttctgagcctgagtgttcaagcgcaccggaaaggacggtgtcgggatggttgttgacggcttcaaccaatacgcgtcccatacggccgtttgcgccggcgatggcgattttgagcggtgtcatgtgtgttccttatggtttgtctgtgttttggcggtctttgagggcttcggcagcgttttgcaggacgtcgccttcggtgcggacgagtacgccgttttcaaaatagacggtcagattgctgcgttctttgatgatgccgttgcgggaggtgttgaaggtatagtcccagcggtcggtatggaatgcgtcgcgcagtatggggctgccgagcaggagcaggacttggtctttggtcatgccggggcggagggcggcaacggcgcgcggttcgagttcgttgccctgtatgattttgagtttgtacgaggggaacagtgaaacgcgttcggcactgcacgcggcaaggccgaggagggcggaaagggcgaggatgagggttttgttcacggaaatgcctttctgtgcaaatcgggatgggtagtgtaacactgcttgaatattttataaaagcgaacgataatcatacgattaagcggtatccgccctgtccgcgcatcggccgccggtgcggttttactattgcaaactgctatggtgcgatagtgggcaaacaggccgaaattgcgtattataacgtctattgttttacaggggtattgaatattatggaaaaattcaacaatattgcacaactgaaagacagcggtctgaaggttaccggcccgcgtttgaagattttggatttgttcgagacgcatgcggaagagcatttgagtgcggaagatgtgtaccgcattttgttggaagagggtgtggaaatcggtgtggcgacgatttaccgtgtgctgacccagtttgagcaggcgggcattttgcaacgccatcattttgaaacgggcaaggcggtttatgagttggacaaaggcgaccaccatgaccacatcgtctgcgtgaagtgcggcgaggtaacggaattccacaatcccgaaatcgaagccctgcaagacaaaatcgcggaagaaaacggctaccgcatcgtcgatcacgcgctttatatgtacggcgtgtgcagcgactgtcaggccaagggcaaacgttaaatccggacggtttgttgttcagacggcattcatgattttggatgccgcctgtgtttttggagaactgtcatgcgtattccgctgcttgcccctgacaattatgcctttcccgatcctgcctatgctttggcccggtgcgacgggctggtcggcgtgagcggcgatttggatgcggggcggctgcttgaggcgtatcggaacggcgtgtttccgtggttttcccgggacgggtggtttttttggtatgcggtcgggccccgtgcggtggtgtttcccgacaggctgcatattccgcgctcgctggcgaaaacgctgcgcaacggcagctatcgggttgcggtcaacggctgttttgcggaagtggtcgcgcattgtgcggcagcggcgcgcccgaatcaggacggaacttggattgcgcccgagtttcagacggcatatttgaagctgcacgaaatggggtacgcgcattctttcgagtgccattatcccgatgaaagcggtgaaacgaggttggcgggcggcttttacggcgttcagatcggcagggtgttttatggcgaatcgatgttcgcattacaaccggatgcgtcgaaaatcgcgtttgcctgcgccgtgccgtttttggcggatttgggcgtggaactgatagactgccagcaggatacggaacatatgcgccgtttcggttcggagctgctgccgtttgcggattttgccgaacgtctgcggatgttgaacgccgtgccgttgaaagaggaaatcgggcggcgcgaagtggcgtgcaaggggctttgatggcggcttatgctccggtcaggttcaaatatggtggattatagtggattaacaaaaatcaggacaaggcgacgaagccgcagacagtacaaatagtacggcaaggcgaggcaacgccgtactggtttttgttaatccactataaaattagaaatgacgacagccggataaaatcacggtgaaaatgaaaaatgccgtctgaaacttgaaaacatcgggtttcagatggcattttgtttgacggtttgttgcttatttgagcgggcgcacttcaagtccgaacatacggcgtgcggtgttcagcatttggcagctgaagccccattcgttgtcataccaagcgaacactttgaccatgttgccgtcaacgactttggtcagtgttgcgtcgaagtggctggcttcggtagtgtggttgaagtccatggaaaccaagggcagggtgttgtagcccaaaacgcctttgagcgggcctgcttccgaggcggctttcatcagtgcgttgatttcttcgactgtggtgtcgcgcgcggcttggaagctcaaatctaccaatgatacgttgacggtcggcacgcggatggcaagcccgtcgagcctgcctttcaattcgggcagtaccaaaccgacggcttttgccgcgccggttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgcacggtgtcgaatttggtcagatgggcgttggtttcaaggctgccgctggcgttgacggcgacgatttggagttggtcttgaatctgataatcgtagatggcgcgcaaaacctggcggccgatgcgtccgtagccgttgatggcgactttgatgcccatggtttgttcctttgttgagggttgggtagattttcggggcggattatagcaaatttgtagtggcgtgtaattaatattttattgaaaacggcgcggccggaagggtgggcggtaagatgcggacggcacgggtgcggcggacggagagcttgataaaatgccgtctgaagcggcttcagacggcatatcagggaagggtcaggaggcggtattctgtgcggcttcctgtttggctttgtattgtttgagatattcgagggcggcggctttttcgctgtcgctgccgtatttcatatcgcgttgggcgcggcgcaactcggcgcgttcgcgggcttcggctatctgtttcgcctgatagtctttgcggttgtcggcggcggcgaggcggtcttgttgggtttgcgcttttgccatggctttggcgatgaggtcggcagggttaaacgtcggttttttcggtgtgtcgggcgtttgcggacgcgcgttgcggacggcggcttcgcgttcggcaagcatggccttgcgttcgtcggcttcgcgctgtttgcgttcgttgcgtttgaggtagcgcgtgcgcgcgtgttcggcggcggcaaaacggctgtcggcggacaggctgaagcggcgcgcgcggggcaggacggtgtcggcaacgggctgcatatggatgcagtcgacggggcagggggcgacgcagagtccgcagccggtgcattcgtcggcgatgacggtgtgcataagtttgcccgcgcccataatggcatcggcagggcaggcgcggatgcaggcggtgcagccgatacaggcggtttcgtctatccgggcgagtgctttggcttgggttttggcaggtgcgacaaagggtttgccgagcagggcggaaatgtcccgaatgacggtttctccgcccggggcgcagaggttgtacgcttcgcctgttgcgactgcctgtgcgtagggcaggcagccgtcgtagccgcattcgcggcattgggtttggggaagcaggcggtctatggcggcggctgtggcggtcatgtcggtgtgcggctcaaaatcgaaagggcgtattttagcagaattgtatgccgcgcccgtttcggatggtgcgcggtgttttgttataatgcggcggcgtatgccgtttcagacggcatttttctgtattttcctgttcggacggtctatgaacgaattttcgcttgcccctattgtgattgttttgctggtgtcggtcattacggtgatcctgtgccgcaagttcaacattccctccatgctgggctacctgctggtgggctttttggcggggcccggtatgctcagcctgattccgaaaagccatgcgacggattatttgggcgaaatcgggattgtgttcctgatgttcagcatcggtttggagttctcgctgcccaagttgagggcgatgaggcggctggtgttcggtctgggcggtttgcaggtcggcattacgatgctgtcggtaatgggcatactgatgctgacgggcgtgccgttcaattgggcgtttgccgtgtcgggcgcgttggcgatgtcgtccacggcgattgtgagccggattttgtcggaaaagacggaattggggcagccgcacggtcagatggcgatgggcgtgctgctgatgcaggacatcgccgtcgtgccgctgatgattctgattcccgcgctggcgggcggaggggacggaaatatttgggcggccttgggtttggcgtttgcaaaaatgctgctgacgctggggctgctgtttttcgtcggcagcaaaattatgtcgcgatggttcaggatggtggcaaaacgcaaatcgtccgaactctttatgatcaatgtgctgctggtaaccttgggtgtggcttatctgactgagctggaaggtttgtctatggcgttgggcgcattcgttgccggcatgctgctttcggaaacggaataccgtttccaagtcgaagacgacatccgcccgttccgcgatattttgctcggctttttctttatcacggtcggcatgaagctggacattcaggcattgatcggcggctggcggcaggtattgatgctgttggcaatgctgctggtgttgaaggcactggttgtgtttgccattgccttcaaaatgaaacattcggtcggcgacagcctcaaaacggctttgtatctcgcgcagggcggcgagttcggcttcgtgatgctggccattgccgggcagcttgatatggtttcgccagaatgggaacaggcggcgacggcggcggttctgctgtcgatgattatcgcgcccttcctcttgggcggcagcgatgcgctggtcgggcgtttggtcaagtcaagctgggacatgaagtcgctcgatctgcacagtatgctggtagaaaccatgagcaagtccgaccatgtgctgattgtcggcttcggcaggggcgggcagacggtcggacgcgtccttgcccaagaggatattccgtatttcgcgctcgacttggacattgcgcgggtgcaggttgccagaagtgcgggcgaaccggtgtcgttcggcgatgcgaaacgcagggaagtattggaagccgccggtctgggacgggcgaaaatggtggtggttacgctcaacaatatgcacgaaacgcaacacgttttagacaatgtgctgtccatgtatcccaatatgcccgtatatgtgcgcgccaccaacgacgattatgtgaaaacgtttaccgatataggtgcggaagaagccgtgtcggacaccaaagaaaccggactcgtgctggcaggctatgcaatgttaggcaacggcgcgtcgtatcggcacgtctatcagacgatggcaaatatccgccacagccgttatgccgcgttggagggactgtttgtcggtagtgatgatgaggcaggattcggcgaaaacggcgaaaccgtccgtcacgcctttcctttggctgcagaagcatacgccgtcggcaaaacagtcggcacgcttccgatggcggcttacggcatcaaactcttgttcgtccgccgccgcaccggccggattgaaaacccggatgcctcgtttacattggaaggcggtgacgtgttggtggtcgcaggcaaaaaagaagaaattatctcttttgaaaactggagtttgcagggaatataaatgaaatgccgaaataaggcttgcgccatttccggttatttggtttaataacgctttcgcaaatcgcaagggtgattagctcagttggtagagtgtctgccttacaagcagaatgtcggcggttcgactccgtcatcacccaccaagttttctttcattgttgcaaacaatggatgcgcggtggtagctcagttggttagagtaccggcctgtcacgccgggggtcgcgggttcgagccccgtccgccgcgccaagtttcaaaatactgactctgtcggtattttttatacacgggtgattagctcagttggtagagcgtctgccttacaagcagaatgtcggcggttcgactccgtcatcacccaccaagttttctttcattgttgcaaacaatggatgcgcggtggtagctcagttggttagagtaccggcctgtcacgccgggggtcgcgggttcgagccccgtccgccgcgccaaaagttaaggaataccaacctccggttggtatttttttgtttgtatgctttgaaaaatgtttgtttccggattttgccattcccatccggttttgcgctgtacgatgtgttttagcgcggacttgctcaaaatcgcatgtgattccggtatttgaggctttgattagggatgcggactttcaatatattttctcagctacaacaacgaaggcttgatgtctgtcgggcaggtaagggagatttttgagcgtttcggcaaatataatttggttcaaacggaataccggcgttttaaggcagataagacagaaaaccgtaatcataaggcaaattcgatattcgaatttctgcatattttagaaaagaccttttatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaatccactataaaaattcttgccggatgctgcaaacaacgccggtttgcattcctgatggcggtggttttcttagacgaacgcccgaacacgcaggaatggataggcttggggctggttacggcgggcgtgttgacgctggcactgaaacggtaaagccgcaagaaataaatgaaatgccgtctaaaaaactgttttcagacggcattttcgtttctgtccatcctcagcactcgaccacgcgcacggatacggggacggcttttttccggagcgtggcggcgagtccggcaagcgaggtttctttgtaggtcgccttcatatcccggccggtttgcagcatggttcggatgacttcgtcgagcgagacttttttgtccgtgccgtcttccaaaagcgcgagcgtgccgagtttgagggctttttcggcggcgatgccgttgcgctcgatgcaggggatttgcaccagtccgccgacggggtcgcaagtcagccccaaatggtgttccatcgccatttcggcggcgttttccacttgtttgggcgtgccgccgatgacttcggcgtatgcgcccgccgccatcgaacacgctacgccgacttcgccctgacagccgacatccgcaccggaaatggaggcgttggtcttgtagaggatgccgattgcgcctgcggtgagcaggaagttttcgacgcgttcctgtgtggcgtgcggattgaacttgcggaaatagtgcaatacggcgggaatgatgcctgccgcgccgttggtcggtgcggtaacgacgcgtccgccggcggcgttttcttcgttgaccgccatggcgtacaccatcggccagagctgggtgttgacgatttcggtttcgcgcaggactttgagcttggcggcaagctgcggggcgcggcggcggacgttcaatccgctgggcagttcgccgtccgcacccaagccgcgtttgatgcagccttccataacctcggcaacggcagcggcgcggcggcggatttcggcttcgccgcatccggcaagcgcggcttcgtttgccaacacgacttcggagatgtcgagccggttcagacggcatcgggcaagcagttcggcgcaactggtatagggatagggaacggctttttccgtttccgcctgccggtcaaaatcttcttcggtaacgacaaagccgccgccgaccgaataataaacctgttcattcaataccgtgccgtctgaagcataggcggtaaaacgcaggctgttggggtgtttgggcagcacttgattgccgagtatgttcaggtcgcggtcggggatgaagcggatttcttgcccgttgagccggaggatgtgctgcgtgcggatgcgttcgaggcgttcgggaatgccggcaagcgggatgtcgtgcggcaggctgccttccaaaccgagcatcagcgcgtcaaatgtaccgtgtccgtatccggtcagtgcgagcgagccgtaaatgtcgatgacgatgcgaacagcctgtgcatccaaacctgccgcaaaggcggcggctgccttcatcgggccgaccgtatgcgaactggaaggcccgataccgattttgaaaatatcgaaaatgctgatcatattttgctccgacggtttttcagacggcacaggttccgtttgaccaaccaaaaaggagacgcggcacgatgcccgtctccttttttaaaacggcacttatgcgtcgatattttgggcaatcagcgcgttgttttcgataaaggcacggcgcggctcgacctcgtcgcccatcagcgtaacgaacacttcgtcggcggcaatggcatcttcgatgcgcactttcaacaggcggcgcacggcgggatccatcgtggtttcccacagctgctcggggttcatctcgcccaagcctttgtatcgttggatggacatacctttttgggcaacgctcatcaagatgtccaaagcggtttcaaagctgtccgcgtcgtacccgttttcgcctttgtaaagcttggcaccctcgccgaccatgcctttgagcgcggcggcggtttgggtgagggtttggtaggctttgctgttgaggaacttgggttcgatgtagctgaccatgacgttgccgtgcagcttgcgcgtgattttgatgaaccggtgtccttcatgaccttcgatgcgttcgagggcgacttctttttcgtcaagcagaccggaaagttcggcaacggctttatcggcgttttcagacgacgtcaaatcaatgggcgacgcgtgtagcatggcgcgcaggacgagttcgtctacgaagcggctttcctgttcgatgacggtttttgccaacaggaattgtttggcggtgtcggcaagttctgcgccttcgatggtgcggccgtctgaaatgattttggctttttccaaggcaagaccgagcagccattggtctttttccaactcgtccttgaggtaacgttcctgtttgccgtatttcgctttatacaaaggcggctgggcgatatagatgtagccgcgctcgaccagctcgggcatttggcggtagaagaaggtcaggagcagggtgcggatgtgcgcgccgtccacgtcggcatcggtcatgatgatgatgcggtggtaacgcagtttttcggcattgaattcttctttgccgatgcccgcgcccaaagcggtaatcagcgtggcgacttcttggctggccagcattttttcaaaacgtgctttttcgacgttcaaaattttacctttgagcggcaaaatcgcttggaatttgcggtcgcggccttgcatggcggaaccgcctgcggagtcgccctcgacgaggtagagttcggacagggcagggtctttttcttggcagtcggcgagtttgccgggcagtcccaagccgtccatcacgcctttgcggcgggtgatttcgcgtgctttgcgggcggcttcgcgcgcgcgggcggcatcgacgattttgccggtgatgattttggcttcgttcggattttcttcgaggaagtcggtcagggcttggctgatgacttcgttgacaacggggccgatttcgccggaaaccagtttgtctttggtttgggacgagaatttggggtcgggcagtttgacggacaacacgcaggtcaaaccctcgcgcatatcgtcgcctgcggtttccactttggcttttttggcgacttcgttggcttcgatatagttgttgatggtgcgggtcatcacttggcgcagtgcggtcaggtgagtaccgccatcacgttgcgggatgttgttggtgaaacactgcacgctttcttgatagctgtcattccattgcatcgcgcattcgacgctcatgccgtctttttcgccgaacgcgtagaagattttttcgtgcaacggcgtttttttgcggttcatgtattgcacgaaacccgccacgccgccggaaagggcgaagctttcgtgtttgccgtcgcgctcgtcggtcaattcgatgtccacgccgttgttcaggaaggaaagttcgcggatgcgtttggcaaggatgtcgaagctgtattcgacgttgccgaaggtttccgtactggcgaggaagcgcacggtcgtgccttttttatcggaatcgccgacaattttcagcggctcttcggtttcgccgcgcacgaagcggacgaagtgttctttgccgtcgcggtagatggtcagcgttacccagtcggacagcgcgttgacgacggacacgcccacgccgtgcaggccgccggagattttgtagctgttgttgtcgaatttaccgcccgcgtgcaatacggtcatgatgacttcggcggcggagcgtccttctttcgggtggatgccggtgggcataccgcgcccgttgtcggcgacgctgacggaatggtcggcgtgtatcgttaccgtgattttgtcgcaatgtccggcgagtgcttcgtcaatggcgttgtccaatacttcgaacaccatgtggtgcagaccgctgccgtcctgcgtgtcgccgatgtacatgccggggcgtttgcgtaccgcttccaagccttcgagcacctgaatgctgtcggcgccgtattcttcgtgtttttgttcagtcatattttttgccggattttgaaaagattttgcgatgccgccaaaacaagtccgcaccttgtagaaaaagcgggcgggacgacatatataattgtgtattatagccgattttgccgcctaattcagcgttatccgcatcagtgtgccgccgggaaaagatgaaacggtacgtttgcctccggcatcaggtcggggattgtcccgtaaagtggcaaaagcgtttttttgccactaaaatctacaccctatacttttcggacaggggcgcggaaatggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaactttccccgaccgaccccatttccggcttcagacggcatattgccgatatgctgtctgaaacacaacacgcaaaggaaacccatcttatgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctgacggcagggttgaagtaaaaaatatggcggattcgatagaaaaacatccgcaccgtcattcccgcgcaggcgggaatccagaccggtcggtgcagaaacttatcgggaaaaacggtttctttagattttacgttctagattcccactttcgtgggaatgacgcggaaaagttgctgtgattccggataaattttcgcaacgtttaatttccgttttacccgataaatgcccgcaatctcaaatcccgtcattccccaaaaacaaaaaaatcaaaaacagaaatcccatcattcccgcgcaggcgggaatccaggtctgtcggtgcggaaacttatcggataaaacggtttctttagattttacgttctagattcccgctttcgcgggaatgacggaatatttttgaatttgataaaaatgccgtctgaaacggtcaaacaacgcttcagacggcattttatagtggattaacaaaaatcaggacaaggcgacgaagccgcagacagtacaaatagtacggaaccgattcacttggtgcttcagcaccttagagaatcgttctctttgagccaaggcgaggcaacgacgtactggtttttgttaatccactatattttccgacatcattgaatcaaacccaaatgcgacaagagcgtccatgtgccgatggcaatcaacaccaaacctccggcaaattccgcacacctgccgaacaatacgcccaaagcccttcccgccgtcagcccgaccgccaccatcaccgtcgtcgccataccgatgattgcggcggcaaaggcgatgtttacctccataaacgccaagcccaccccgactatcatggaatcaatactggttccaaaagcagtcaaaaccgtcatccataggctttcccgtttgctttcgcgcacatcttccgcctcgccggacagcccttcgcgcatcattttcagacccagcccgcccagcaggacgaaagccacccaatggtcccattcgctgataaacggcttggcataaaaaccgcctacccagcctgccagcggcgtgagcgcttcaaccgtgccgaacaccaaagccgttgccgcaattttgcgcggaggcattctgaccgccgcaccctttgccaatgcgacggcaaacgcatccatcgacatccccagagcaatcaagagcaaagcataaaaacccataccgcacccgtcctcaaaaagggcggattatagcaaaagcaaaaaaatgcaaaaatgccgcacgaaaacccgcatcccgtcattcccgcaaaaacaaaaaatcaaaaacagaaatcccgtcattcccgcgcaggcgggaatccagagttgtcggtgcggaaacttatcggataaaacggtttctccaaccccgagtccttgattcccactttcgtgggaatgacgggatattttgcgtttaataaaaaacgcccgctgaaacggcggggcgggatgggggaatgccgtctgaaacggtcggacaatgtttcagacggcatttttatgcccggttatttccgatagcggacggcgcgggacaggatttcttcaatttccatccacataatgcccccttacagcaaaccagcctgacccagtgcgggatcggtcgcgcgggcggcttgggcatcttcgacagtcagtccaagggctttggccacgccttcgccgtatgccgggtcgcaacggtagcagttgcggatatggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgtgccgcgtcgccgttgattttcaaaggcggttcggcgaagtcgggttgttgctgccattggccgaagctgttgggttcgtagtgcggcaggctgccgtagttgccgtcggcgcggccttgcccgtcgcgctggttgctgtgaacagggcaacgcggacgattgacgggaatttggcggaagtttacgcccaaacggtagcgttgtgcgtcggcgtaattgaacaaacgcgcttgcagcattttatctgggctggcgccgacaccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgataaggtactttttccgcgtctgcttcaggcatgacttggatgtacatcgtccatttcggaaactcgccgcgttcgatggcttcgtataagtcgcgctgatggctttcgcggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtataaaatttcaaggcaaaaccgcggatgtcgcgttctgcatcggctgcgccgcgttcgcctgccacggtggtgaaacgggcgaacatctcggtttttttgccgacttcgctgaagattttggcgcgggtgtatttggtgatgtcgtgcgttacggtaaacgtaccgaacgcgcccgaacctttggcgtgcatacggcgttcggggatgacttcgcgcacgaagtcggcgagtttttcattcagccacaaatcctgcgccagcagagggccgcgaggaccggcggtcaggctgttttgattgtcggcaacaggcgcgccgttgttcatggtcagatgggttacagggcatttggaggtagtcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaaaactatgaaatcgatttaatattattataagcaatcggttcttgattttcgtttgttttttgttatcgaacggaatccgaacccgctcattaaaaccatttataatgcaatgacgctttgcggcattttttgcgccgacaggctgaaaataacaattttccccacattatcatgaccttactcggaataaagctcaaacagacccagcagctcaaccagcggctgcaacaatctttgcgcgtattgcagatgtcgggtatcgaacttgaacgcgaggtcgaaaactggctgtcggacaaccccctgctcgaacgcaaagacacggatgaattttccgatgccgagttcagccattacactgcgcctgcccgtcaaatcggcggagacgaaggcgaagatatgctgtccaacatcgccggcgagcaggatttcaagcaatacctgcacgcgcaagtatgcgaacacccgctttccgaccaagaagccgcctgtgtccacatccttatcgatttccttgacgagcagggttatctgaccgacagcatcgaagacatcctcgaccatacgcccttagagtggatgttggatgaagcaatgctgcaacacgcgctgaccgcattgaaaaaattcgacccggcaggcgtggccgccgccgatttgaacgaatcgctgatactgcagatagaaagattgggcgaatgtgctgccaaacccgccgccctgcatatcgtccgaaacgccctcgacagcattgacggcaaccgcagccaaaccctcgcacgaataaaaaaacacctgccccaaaccgacagcggcacactcgaagccgcactcgacctcattgcttcgctcaatccctttcccgccgccggttttgcctcgtccacgcccacgccgtattctgacgaggcgctcgccaacctgctggctttccgcggcatggaggtttctcgccgcaccattgccaaatacagagaatcctttgagattccggcagcacacaaacgcaaaaccgcagaataattgccgaataatcttataaagacaacaaaccaaaagccggcatttctgcgaaagcgggaatgccgaatccgtccgcgcggaaacctgcatcccgtcattcccgcgaaagagggaatctagaaacgcaaagctgcaagagtttatcggaaatgaccgaaactcaacgaacctggattcccgctttcgcgggaatgacgggggtttggcgggaatgacgagggtttgggatttctgtttttgaatttctgtttttgtgagaatggcaagattttcggttcttgtatggataacgagattttagatggcgggaatttgtcgggaaaacagcaatctgagacctttgcaaaaataatctgttaacgaaatttgacgcataaaaatgcgccaaaaaattttcaattgcctaaaaccttcctaatattgagcaaaaagtaggagaaatcagaaaagttttgcattttgaaaatgagattgagcataaaattttagtaacctatgttattgcaaaggtctcaatctttaccgtcattcccacgaaagtgggaatctagaaacgcaaagttgcaagaatttatcggaaatgaccgaaactcaacgaacctggattcccgctttcgcgggaatgacgagggtttgggatttctgtttttgaatttctgtttttgtgagaatggcaagattttcggttcttgtatggataacgagattttagatggcgggaatttgtcaggaaaacagcaaccctccgccgtcattcccacgaaagtgggaatctagaaacgcaaagttgcaagaatttatcggaaatgaccgaaactaaacgaacctgaattcccgctttcgagggaatgacgggggtgtggcgggaatgacgggggtttatcagaaatgaccgaaactcaaaagcgggcagccttgtttacgccttcaaaatatcgagcaatttcaaatcgactttttcggcatcgaatttatctttggcaatcgcataacttgcattccccatcaggcggacggcttccctgttttcgataaaataaatcattttttcggccaagatgcggggattccaaggctcgatcaggaagccgttgaccttgtcggcgaccgtttccctgcatccggggacatccgtcgtaatcactgccctgccgacggccattgcctcctgagtgcttcggggaacgccttccctataataagacggcaatacgaatatatgatgttcttttatcacttcggaaacattgttcacaaaaccggggaaacggataatatcgcgggcggcaagccgttccaaatcgcccccccccccgcgtgatttgtcgattgcgcccaaagcggtaaaaaccgtatcggggtatttgtccttaacctgttccgccgcccgaataaaatcatcaatccccttttctttcagaaatctgccgataaagaggaattttacgggttctttttcatcgggaatatccgcctcggaataaggatattgccgcaaatccagaccgattccgcccaaaatatggatgttttttattttgatgccgtatttgtccgtcagttcgtctttgtcgtcggggtttaatacaatcaggctttccaacatcggcagggcaatgcggtataaggcaatcaaaatcccctttatgatttttgtttttaacggtatgccttccggctgcggggtaaatgcgaatcccaaaccttccagcatcccgacgattctgggcacgcctgccagttttgcggcaaaagtgccgaaaatcacgggttttgcgaaataagggaaaaccaaatccggcgatatttttttgagttctttaaagatgaggaaggtggattttatatccgaaaacgggttcagcccgctgcggtttgaacggtaggtaacgggtgtaacccccatttccctgataatatccaattcattgtcggaaaactccgatacaaaggcatacacctgatggtttttgccgattaattttttaatgacgggggcgcggaaaccgtaaatgctggatgcgactgttgtgataaaaacgattttcataaggcggacaccttgaatatggattggaaatgcggtctgctacggcagggtttcatcctgtaacccagcaaggcttgggtttgcctgcgtattatagtggattaacaaaaaccggtacggcgttgccccgccttagctcaaagagaacgattctctaaggtgctgaagcaccaagtgaatcggttccgtactatttgtactgtctgcggctcgccgccttgtcctgatttttgttaatcactataaaaatgccgtctgaaacggtttcagacggcatttcgatgtcggcggcggctttgcggaatcagcctttgaagcgtttgaagaccagcgtgccgttggtgccgccgaagccgaaggagttggaaatggcaacgtcgatttccgcgtcgcgcgcttcgttggcgcagtagtccaaatcgcagccggcttcaacgtcttgttcaaaaatgttgatggtcggcgggattttgccgtcgtgtatcgccaaaatgctgtacacggcctccacgccgcccgccgcgccgagcaggtggccggtcatggatttggtcgagctgacgacggttttgtaggcgtgttcgccgaacgcgcgtttgagggctttggtttcgttggcatcgcccaagggggtggacgtgccgtgcgcgttgacgtaatccacgtcttcgggattgatgccggcatctttcagcgcgcgggtaacggcaagggcggggccttcttcgttcggcgcggtgatatggtaagcatcggaactcatgccgaagccgacgatttcggcgtagattttcgcgccgcgttttttggcgtgttccaattcttccaacaccaatatgcccgcgccttcgccgataacgaagccgtcgcggcctttgtcccacggacgggaagcggtggcggggtcgtcgttgcgggtggagagggctttcatcgcggcaaaaccgcccacgcccaaagtgctgattgcgccttccgcgccgccggcaaccattatgtccgcgtcgccgtatttaatcatacggagggaatcgccgatggcgtgcgcgccggtggtgcaggcggaaaccatcccgtagctcgggccgcggtagcctttgaggatggtaacgtgtccggaaatcagattaatcagagaaccggggataaagaaagggttgattttgcgcgcgccgccttcgattacggctttgccggtgacctcgatgccgggcagtccgccgatgccggaaccgatgttcacgccgatgcggtctttgtcgaggttttccacatcgtccaaacccgaatcggcgattgcctgcaatgcggcggcaatgccgtagtggatgaatacgtccatccggcgcgcttctttcgcgctgatgtattgtccgatgtcgaaaccgcgcacctcgccggcgacacggctgttgatgtcggatgtgtcaaagcgggtaatcgcgccgatgccgcttttgccggtgagcagggtgtcccaagcctctgcgacagtgttgccgacaggggaaacctgacctaagcctgtaatgactactcttctctgactcatgataacctcgctgttggttgtcggaatgggggcatatgcggctgtcgtgcagatgccgtctgtaatttgcggcaggggttcaaacagtttgccatataagggaaaagcctctattgcgcggtgcagcagaggctgttgtgtcgggcgacgaccggttagccgttgtgggcattgatgtagtcgatagccagttggacggtggtgattttttcggcatcttcgtcggggatttcgcagccgaatgcttcttccaaagccataaccagctccacggtgtccaaagaatccgcgcccaagtcgtcttggaaggaagattcgtttttcacgtcggcttcgtttacgcccagttgttcagcaacaatttttttaacttgttgttcgatgtttgacatatcagtcgttcctttatgccttgcggcaggttgtttaagggaaataaatcggtggtattgtaccgacttttaatagagttttctatctaatgactattatatcaatatttgccgatttgtacatttttgggtgcggcgggttttgtcgttcaagtttgacctgtgtgccgtatgtttggcgggatttcggttaaaatggcggcatttccatctgaagcagaaagccctgtcatgtatccacttgcccgtcgcatcctgtttgcactcgatgccgaaaaagcccaccacttcacgctcgacgcgctctacacggtttataaattgggtttgattcctgtaaccgacaaccgtaccaaacctgtaaaattgatgggtatggatttgcccaaccctgtcggacttgccgccggactcgacaaaaacggcgaatacatcgacgcattgggcgcgctcggctttggtttcatcgaaatcggcacggtaacgcccaacccgcagcccggcaacccgcagccgcgcctctttcgcgttcccgaacaccaaggcatcatcaaccgcatgggtttcaacaaccacggtatcgacaccatgatacgcaacatcgaaaaaagtaaattcagtggcgtattgggcatcaacatcggtaaaaacgcggttacacccatcgaaaacgctgccgatgattatttaatctgccttgaaaaagcctacgcacacgcaagttacattaccgtcaatatttcctcgcccaacactaaaaacctccgcgcgctgcaaggtggcgacgagttgagcgcattgcttgaggctttgaaaaacaaacaggcacagcttgcctctgtacacgggaaatacgtcccgctcgccgtcaaaatcgcccccgatttggatgaagcacaaatcgaagacatcgcccacgttgtcaaatccgtcgaaatggacggcatcatcgctaccaataccaccatcgacaaatcaagtctcggcagccatccgctcgcaggcgagcagggcggtttgagcgggctgcccgttcatgaaaaaagtaatcgggtgttgaagctgttggcagaccacatagacggcaagctgccgattatcggcgtaggcggcattatggaaggcgaggactcggcagataaaatccgcttgggcgcgaccgccgtccaagtgtacagcggattgatatacaaaggtccggcattggtcaaagaatgtttgaaggctttggcgcgatgacgcgatccgcccaaaatgccgtctgaacgcacgttttgccgttcagacggcattttcatttcctttttccgcctgacgccccttgaaaatcccttacgcgccgccctgtttgaaataaggcaaaccgatgcgtgaacacggagcaggcaatcggagtaaaaaatgaaccttgatttaaccgcgcaaaaagtccgtctttcttggaaggatattctgtgggggtatgggaataaatacttgggttgggctgatgtggcagcttatgcccgaaaaatgacgctttcagatcatgatgaacgtgtgttcaaactatctttaatcaacaaatccaatattcttgaattaaagcctgttctggaagatttggcttcggaaatgagggattattcccctaaaaattggctgtacgtcctcttaagcgatgtattccatagaaaagaagaatttgaggatcctttgggggaagttgaaaaaatttatgcagattttgattatccggaagaaatagaatcatttgtcaggtatatgccgcccaaagacggttatattccttctgcccacacctatgaagaaaatattgcccggttatattctcactgggaacactatttgaacaacggcggagggcagggttaaaaccggcaatccgatgccgtctgaagcattatccggccttcagacggcattttgttttccgacagtttataaactgtcgttgtttcttgacagaaacaacgaccttatttgaaacgattggaggacatgattatgggtttttggaatggtgtggcaaaagcagcaaaagcagtgggagagggaatgattgaagccggcaatgagcataaggcgttgaaaatggaatatgcggagaaatcaagtgaggagctgcatgaaatcgtcaagagtgatggtttttttaaaaattccacacgggagaaaagtgcggcttatgctattttaaaagagcgtggcgaggtgtgaacaggaaacggcggcatttgccgctgttttttattggtaggcatccgtccgaatatcggggcaaggtttcagacgacatcgaaggttgctatgatatagtggcttgactttaaaccggtacggcatcccctcgccttgtcctgatttaaagttaatccactatctcattcccgtcatccttccaaacggaatccgaaatgtccgacaaccgcctcgacaccgcccgccgccattccctcttcctcgcccgccagctcgacaacggcaaactcaagcccgaaatattcctgcctatgctcgacaaggttttgaccgaagcggatttccaagcctttgccgactggggcgaaatccgcgcggaagaaaacgaggaagaattggcgcggcagttgcgcgagttgcgccgttatgtggtgtcgcagattatcgtgcgcgatatcaaccgtatcagcgatttgaacgaagtaacccgcacgattacgctgtttgccgattttgccgtcaataccgcgctggattttgcctacgcctattatcgggacatgtacggcacgccgatcgggcgttataccaaatcgccgcagcatttgagcgtggtggcgatgggcaaggcgggcggctatgagttgaacgtgtcttccgacatcgatttgattttcgtctatcccgaatcaggcgacaccgacggcaggcgcgaacggggcaatcaggaatttttcaccaaagtcgggcagaaactgattgcgctgctgaacgacattaccgccgatgggcaggtgttccgcgtcgatatgcggctgcggccggacggcgattcgggcgcgttggtattgagcgaaaccgcgctggagcaatatttgattacacaggggcgagaatgggaacgctacgcgtggtgcaaaggtcgcgtggttacgccgtatccgaacgacatcaaagcactggtgcgcccctttgtgttccgcaaatatctggattacggcgcgtatgaggcgatgcgtaagctgcaccgccaaatcagcagcgaagtcagcaaaaaaggcatggcggacaacatcaaactcggcgcgggcggcatccgcgaagtcgaatttatcgcccagattttccagatgatacgcggcggacaaatgcgcgcgctgcaactgaaaggcacgcaggaaacgctgaagaagcttgccgagctgggcatcatgctgtctgaacacgtcgaaaccctgcttgccgcctaccgcttcctgcgcgatgttgaacaccgcctgcaatactgggatgaccagcaaacccaaaccctgccgacctcgcccgaacagcggcaactgctcgccgaaagcatgggtttcgacagttattccgctttttcagacggtctcaatgttcatcggaacaaagtcaatcagttgttcaacgaaattttgagcgaacccgaagagcaaacgcaagacaacagcgaatggcaatgggcatggcaggacaaacccgacgaagaagggcggcgatgccgtctgaaggcgcacgggttcgatgccgaaaccgtcgccgcaaggctcgaccaaatccgccacggccataaataccgccatctttccgcacacgcccagccgcgtttcgatgcggttgtgccgctgttcgtacaggcggcggcagcgcaaagcaacccgaccgatacattgatgcggctgttggattttctcgaaaacatcagccgccgatccgcctatctcgccttcctcaacgaacatccgcaaaccttggcgcaactggcgcagattatgggccaaagttcttgggtggcggcgtatctgaacaaatatccgattttgttggacgaactcatcagcgcgcagcttttggataccgcgtttgattggcaggcgctcgccgccgccctttcagacgacctcaaagcctgcggcggcgatactgaagcgcaaatggacaccctgcgccgcttccagcacgcccaagtcttccgtctcgccgtccaagacctcgccggactgtggacggtagaatccctctccgaccaactctccgccctcgccgacaccatcctcgccgccgccctgctgtgcgcatgggcggacatgcccaaaaaacaccgcgacacaccgcaattcgccgtcgtcggctacggcaaactcggcggtaaagaactcggctacgcctccgacctcgacctcgtctatctctacgacgacccccaccccgacgcaggcgacgtgtacagccgcctcgcccgccgcctgaccaactggctttccgccgccactggcgcaggcagcctctacgaaaccgacctgcgcctgcgccctaatggcgacgccggtttcctcgcccacagcatcgccgcctttgaaaaataccagcgcgaaaacgcctggacgtgggaacaccaatcccttacccgcgcccgcttcatctgcggcacgtccgaaattcagacggccttcgaccgcatccgcaccgaaatcctcaccgccgaacgcgaccaaaccgccttggcaggcgaaatcatcgaaatgcgcgaaaaaatgttccccacccacccgcctgccgacagcaacgtcaaatacgcgcgcggtggcgtggtcgatgtcgaatttatcgtccaatatctgatacttgcccatgcccgccagtatccgcaactcttggacaactacggcaacatcgccctcttaaacatctccgccgactgcggtttgattgacaaaaccctcgccggacaaagccgcaccgcctatcgcttctaccgccggcagcagcacaacaccaaactgcgcgacgcggcaaaaaccgaagtaaccggcgaactgttggcacattacggcaatgtcaggaaattgtggcgggaagtgttcggcgaagaagcggcaaccgtctgaacaaaaaatgccgtctgaagcctgacaatctgggtttcagacggtattttcgtaccgtgccgttttaaggttgcggcagagctaaagcgatttatcgggaatggctgaaacccaaaaaccggattcctctttcgcgggaatgacgggatttcaggcttctgtttttgtgggaatgatgggattttttatccaagcaaaaatcaaaacaaacaaataagaaccgtttaaaaccccgccgtttccattaaaatagcgcattctactttttagacggccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgacctctttcagttacagcagcttgatccctttcccttatccaacgggggaaggctaggatagggtggcttgcaaatatacagaacaagggacaagagccaccctctctccaaccctctccctccgtacgggagggggtggattctcgcgggcgaagcccacgctacggttagcctttaccccagcacaaacaattcccgcccgtgcgccttcagccaacttttagcattgtcggtatgcggcgtcagcgtgttcaccaaatgccaaaagcgcggactgtggtcggggtggcggaggtggcagagttcgtggatgcagacatagtcggcgacgtattcgggcgtgccgatcagccgccagttgaggcggatgccggtgtgcgggcggcatacgccccaaaaggttttggcgttgctcaggtctgtggcggtgggcgtcagtcctgtttcggctgcgtgtttttcaaggcggggcagcaggtattcgcgggcgcgttcgttcaacaggcggcgcaggtggtcgatttgtgcggcggtttcttttcggggaagcaggatttcagacgacgtgatacggatatggctttggctgtgggtatccagcttggtctttattccccgataccaaatccactcgggtaagtttgggtgggaaacaggatgcacgggcgttttggcaagcgtgttccgcaaaatcgtttcgtttgccgccagccagtttgctaacgcgtggtcttgaaaaaagggtgggacgttgatgctgaccgtctgcatattgacggggcgcagaatcagatttttcttggcactgcgtttgagttcgatttcgatgcacaaaccgtcggaaagagtataggtgaagcgtttcatagttgtgaataggtttcagaccggatacatcgtctgaaacaggaattttccatatcaggcggcaaacttcggataatatacaaaatcaaacatctgcgctacaaggttcagccgaacaagccgccgatatatttgctgatggtgatggcgctgagtactgccatcaaaccgaccacaatcacgccggaaacggtgagccacagcgggtgtttgtagtcgccgacaattttggttttgtaggcggcaatcagaatcagaccgagggaaatcggtaaaatcaggccgtttaatgcgcctacgaacaccagcacctgcgccggtttgccgatggtggaaaatacggcggtggacacggcgataaaggcaataatccatttgtttttattgcgttcgatagacgggctgagaccggagaagaacgacaccgaagtataagccgcaccaatcaccgaagtaatcgaagccgcccaaatcaccacgccgaaaatcagcaggccgatgtatcccgccgcatattcaaacggtgtggaagcagggttgtcgggattgagctgtacgccttggctgaccacgcccaaaaccgccaaaaacaatacaatccgcataatcgaggcaatcaggatcgcccgcaccgagctttggctcacttccggcaacgccgatttgcctttgatacctgcgtccagcagacggtgcgcaccggcgaaggtgatgtagccgccgaccgtgccgcccaccagtgtaacaatcgccattgcatcgagtttttccggcataaaggtatgcacggcggcatctgccagcggcggattcgcctgccatgccacataaaccgtcagcgcaatcattacgaaacccatcacttgggcgaatttgtccatcactttgcctgcttctttaaacagaaacacaccgatggcaatcacgccgctgatcacggcaccggtttccggtgacagtccggtcagcaggttcagacccaagcctgcgccgccgacgttgccaatattgaacgccaaaccgcccatcacaatcagcacagccaagaaatagcctgcgccgggcaagacctgattggcaatatcctgcgcctgtttttcggaaacggcgacaatccgccaaatattgagctgcgccccgatgtcgagcagaatcgagagcagaatcacaaagccgaaacttgccgccagtgcttgggtgaaggtggcggtttgggtcagaaagcccgggccgatggcggaagtcgccatcaggaatgcagcgccgattaaggcatttctgcggtttttttgatcagacataatcgcttatcctctataaaattggttgttgctgtgtttgggcgaaacctgcggttttagctacgcagaaactcgctttgctcgttttggcgaaacctgcggttttcagacggcctatgaactgtttttcaagcagaaactttgatgcctgccgccagtagttcctgccggattttttcggcaaacaccacggcgtgcggcccgtctccgtgcagacagatgctgtcggcttgcacggcaaccaggctgccgtccactgctttgacctgcccgtcccgcaccatctgcaatacttgggcgatggcttcttcgtcgctgtccacctgcgcatcggggcggctgcggggaaccagcgtaccgtcgggcatatagcggcggtcggcgaatacttcggaaatcacacccaagcctgcggcttttccggcttccaagagcaggctgccggaaagtgccatcaatttcaatttcgggtcgaaatccgccacaattcgggcaacggtatccgccagcgcacggtttttcgccgcttgattgtacattgcgccgtgcggtttgacataagccatttccaaaccctgatcacggcacaaggcctgcaatgcgcccaactggtaattcagacacgcccgcaaatcggcttcggacagattcatttcggtacggccgaagttttcccgatcgggatagccggggtgtgctccgatgcgcacgccgttttgttgggcatacgccaatgccgcccgaatatcggcaatgctgccggcgtgttgggcgcaggcgatgttggccgaagtaatcagctgcaacaaggcttcgtcgctgccgcagccttcggcgagatcggcgtttaaatcaacctgcttcatgggtgattctccgtatttggttcagataggcttgtttttgcgccgcagggcggtggcttctttcaagccgattattttgaatttgactttgctgccgaagcgcacctgtgccagcctgcccaaatcggcggcggcaacggtagcgattttcggataaccgccggtggtttgcgcatcggccagcaggataatcggtttgccgccgggcggcacctgcacggttcctgcctgaacagcgtgggacagcatttccaaaggttgcgacagggtcagcggctgtccgtcgaagcggtagcccatgcggttgctatcgctttgcagcgtccacgtttcccgttccagattcagacgccctttttcactgaaagcggcatattccgacgaaggaacaaggtggacggtatcggtaaacggtatcggggcaatgccgactttggacaattcctgcgcacctttgccgatggggagataatcgcctttttgcagcattctgccctgatggccgccgaaaccggctttcaggtcggtgcttctcgaacccatcacttccggcacatcaaatccgcccgccacgcacacatagccgtacatgccctgcacggcacgcaccagtttcaaggtctgccctttgcgggcggtataacgccaatacgaatagaccggttcgccgtccaattccgcctgatacacggcaccggtgagacaaaacggcgtatcccgttcaaacaccagcattatcccgcccaaagcgatttcgattgcggccgtgccttcgtcgttgcccaataaaatattgcccgccgccaaagcaaccgtgtccatcgcaccggcatgaccgatgccgtaacgccggtgtccgtagcgtccggtatcctgaatatgcgccggtgcctgcactgccgaaacgtgaatcatggctcaatcctttctgcaacaaagcggacttggtcacccgccgccagcagggtcggcggattcaaatcggctcggaacaagggtaattcggttctgccgataatctgccagccgccgggcgaagcgaacggatacacaccggtctgactgccgccgataccgaccgaaccggcaggaacggacgttctcggcacggcacggcggggcgtgtgcaatgcttcgggcaagccgcccagataagggaaaccgggctggaagcccatcataaatacggtataagtttgcgccgtatggcggcggacgatttcggaaataaccgtctgatggaaagcagcgacttccgccaaatccgggccgtattcgccgccgtagcagacgggaatttccaccagtttgccctgatggtctgtaacggcggtgtgttcccacacatattgcaattcatcggcaagcgtcgccaaatcggtatcgaaacgggtaaacacggtcagattgttcatgccgaccaccacttcctcaatcctgtcgtgctgcccgagcgcagcggcaaacgcccacaacttttgctgtttgcccagttcggaaggcgcattcagtcggtagaccaaagcggattcgctgattggtgtgatctctattctcatttgttgttcattttggttatgttttaatgaatctatatgcaggggcggcggtttgtcaatatcttctgtgctgcatcatcaaaccgtcgattggaaaagtgctgccctgccgctgcactttttcagacgaccttaaaccgtttctattaaaatagcgcattccacttttcagacggcatccttatgtttcccgaccaatccgcccccaacctgctgcaaggcttgaatcccgaacaactctccgccgtaacctggccgccgcaatccgcacttgtgctggcgggcgcgggcagcggcaaaacgcgcgtgctgaccacgcgcatcgcatggctgttgcaaagcggacaagccagcgtgcacagcattatggcggtaacgtttaccaacaaagccgccaaagaaatgcaaacccgtttgggcgcgatgattcccatcaatgtccgcgccatgtggctcggcacgttccacggtctctgccaccgctttttgcgcctgcaccaccgcgacgccggtctgccgtcttcctttcaaatcctcgacggcggcgaccagctttccctcatcaaacgcctgctcaaaagcctcaacatcgccgaagaaatcatcgcgccgcgttcgctgcaaggctttatcaacgcgcaaaaagaatccggtttgcgcgcttccgtgttgagcgcgcccgatccgcacacacgccgcatgattgagtgctacgccgaatacgacaaaatctgccaacgcgaaggcgtggtcgattttgccgaactcatgctccgcagctacgaaatgctgcaaaacaacgaaatcctgcgccagcactaccaaaaccgcttcaaccacattctcgttgacgagttccaagacaccaacaaactgcaatatgcttggctgaaactgattgccggcaaccacgcagcagtatttgccgtcggcgacgacgaccaaagcatttaccgtttccgtggcgcaagcgtcggcaacatgaccgcgctgatggaagaattccacatcgacgcgcccgtcaaactcgaacaaaactaccgctccgtcggcaacatccttgccgccgccaatgccgtgattgaaaacaacgacgaacgactcggcaaaaacctgcgcaccgacgccgaagcaggcgacaaaatccgctactactccgcctttaccgacctcgaagaagcccggttcatcttggacgaaaccaaagccctcgaacgcgaaggctgggatttggacgaaatcgccgtcctctaccgtagcaacgcccaatcccgcgttatcgaacaaagcctgttccgcagcggcattccctacaaaatctacggcggcttgcgtttttacgaacgccaagaaatcaaacacgcgctcgcctacctgcgcctcgccgtcaatcccgacgacgacaacgccctcttgcgtgtcatcaacttcccaccgcgcggcatcggtgcacgtaccgtcgaaaatcttcagacggcctcaaacgaacaaggcatcaccctctggcaagccgcctgcaacgccggcgcgaaagccgccaaagtcgtcgccttcgtccgcctgattgaagccctgcgcaaccaagtcggacaactgtccctgtccgaaatcatcgtcggcatcctcaaagacagtggcttgaccgaacactaccgcacccaaaaaggcgacaaccaagaccgtctcgacaaccttgacgaactcgtcaacgccgccatcgaattcaaacccgaagacagcaacttcgaaatcctgcctgaaaacatttcagacgaccccgccttccccattctcgccttcctaagcaatgccgccctcgaatccggtgaaaaccaggcaggcgcaggcgaaaaggccgtccaactcatgaccgtccacgccgccaaaggcttggaatttaacgccgtcttcctcaccggcatggaagaaggccgcttccccagcgaaatgagccttgccgaacgcggcggcctcgaagaagaacgccgcctcatgtacgtcgccatcacccgcgcccgcaaacgcctctacatcaccatggcgcaacaacgcatgctgcacggacaaacccaattcggcatcgtctcccgcttcgtcgaagagatcccacccgaagtattgcactacctgtccgtcaaaaagcctgcctacgacagttacggcaacacgcgccaaaccgccgcatccaaagataaaatcatcgacgactacaaacagccccaaacctacgcaggtttccgtatcggacaaaacgtccgccacgccaaattcggcaccggcgtgattatcgatgccgcagataaaggcgaatccgcccgactgaccatcaatttcggcaaacagggcgtgaaagagttggacaccaagtttgcgaaattggaagagatgtaaatttgaaatgtaggtcggatattcgtatccgacctacggcaaaaaccttagcaggagagaatagaaacccgtagcgtgggctttttctatgaatcaagcccaaaatttcagacggcatttttagccgtcattatcgtggatgaagcccacgctacaatgtacacacagagcaaatagagatgtgggtcggatattcgtatccgacaaaaacatttgacgcgtctattgtttccgaaacaccgctgttggaaatgtcggatacaagaatctgacttacggcaaaaaacgtagtaaggacaaagcaaaaggccgtctgaaaacgggaagggcaattttgccgcaaccgccgccgtcattcccgcgcaggcgggaatccagacctttcggcacggaaacttatcggataaaaggtttctttagattccacgtcctagattcccgccggaacataaatgacggacggtaaaagccgggtatgaatacccaccctctgttatcactgagatcaataaggaagaacattatgtcccaagtttttaaagattttgacttgtcctccgtatggaaaactaatagttgggcagatgaaaactacaaagaagccccgtttacccctgaaattttggctgccgtagaaagtgaactgggctataaattgccgcaaagttttattgaattgatggcagtacaaaacggcggaatatttgtcaaaaactgttttccgaccacgcagagaaattcgtgggcggaaaatcatgtgcaaatttgcgaggtatcgggaatcggttttgaaaaagaagggagtttgtgcggcgcgatggggcaaaaactttggctggaagaatgggaatacccgcctatcggcgtgtattttgccaacgacccgtcaggcggtcatgccatgtttgccttagactatcgggcgtgcggcaaagacggcgagccgaaagtggtgtttgtcgaacaagaatcggattttgaaatcgtcgaacttgcccccgattttgaaacctttatccgcagcttgcggcatgaagatgagtttattgacgaagaaatataaaacggtggttgaaaaactgaaatcatcaagagaaaacgggcgaaataacgggtaatcgcttgaatccgtaaggaaaacggtttggtggaacgcgccatccaagacctttgcaaaaaactgtccccgacagcattgacattattaacagaacttatcaattttggagctatctcaaatataattcggttatcctgttgtatccattaaatcatatgcttcaattaattgttgttctagctcttataccaattttggattgcgaattcctgacacaatctcaaattcttctgcatctatgcaaacacctgcataaatttcaataacaagggaacgcaataattgaagctcttctcttgttaaagaaataataatgtcatcacctttgtaattgattatattcataataattttatttttgtttgtcaaagtaagttttgcctaaggttggtctaaatgcagttccaccatcttttgaatttgggtctctgattacaattgctccagacttatcatcccaaattgctcttatgtgtttggattgtaatcttcgaattcccaagaaaaaaatcgtaataagtttgaaagtgtcaaatcccaagtttcttttgagcaatattctaatattttatcaatttcacttttaataatcttatgatcaaactgttctaatattaatgcattagaccaaaaaaaaccttctttattacaatgatgggaaatccatttaggagaacaaatgcaaagtgaaaaaatagatgagccttgttctccttcgattccgatatccaaatctatccatctatggaaattatctggaatttcgggggtaaatttttcaaaatcaatatcatataaatttatgctttttaaatccaatttaatcattagggctgtcctagataaatagggaaattcaaattaagttagaattatccctatgagaaaaagtcgtctaagccggtataaacaaaataaactcattgagctatttgtcgcaggtgtaactgcaagaacagcaacagagcccgacagcattgtttatacggattgttatcgtagctattcatttacgcaagtttaacggcattcccaaagcgcattttgagctgtatttaaaggagtgcgaatggcgttttaacaacagtgagataaaagttcaaatttccattttaaaacaattagtaaaatcgagtttatcttagttgtccaggacagccccattatttttataacaccgtgaagccgcacagcagtttgaacagtgatacgccgtttgcgggcttacgagtttattttcccggcctgcagtttgagcaatacggtgatttcctacggttaatacaaatgtttacacattgatacatttcatttatagttccgcctatttgaaaatagaaaatatgaattcgaccgcaagtaaaaccctgaaaggattgtcgctggtgtttttcgcctctggattctgcgccctgatttaccaggtcagctggcagaggcttctattcagtcacataggtatcgatttgagttcgattactgtcattatttctgtatttatggtcggcttgggtgtaggtgcgtatttcggtggacgcattgctgaccgttttccttcaagtatcatccccctgttttgcatcgctgaagtatccatcggtctgttcggtttggtaagcaggggtctgatttccggcttggggcatcttttagttgaggctgatttgcccatcatcgctgctgccaatttcctcttattgctgcttcctacctttatgatgggcgcgaccttgcccttgctgacctgtttttttaaccggaaaatacataatgttggcgagtctatcggtaccttatattttttcaacactttgggtgcggcactcggatcgcttgccgccgccgaatttttctacgtcttttttaccctctcccaaaccattgcgctgacagcctgctttaaccttctgattgctgcttcagtatggctgcgttacagaaaggatggatatagtgaacactaaaccgaatactagtttgatttatatgctttctttccttagcggcttattgagcttgggtatagaagtcttgtgggtgaggatgttttcgttcgcagcacagtccgtgcctcaggcattttcatttacccttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcagagggttgattttcccgctcgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggactgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggggcggaagttattaccgacgataatatgattgtagaatacaaatacggcagagggatttaaccgtcttaaagggtttcaggcaacgcaggttttaggtaacgtcctgctagttcaaaaaaaccgcatcacagcagtcgggacaaaatggtttaaacattttgtcccgaattcttattcctatatatagtggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccacgaattacggtgtaaaaatttatatgaccttataaaatcaaataagaatcgttatcataacatgattgtatttattgggtttttttgggcgttttgccgatatttaccttttaatggtttttgaaattcgctaaaatacgaaattattgtagaaattttgttaacggatttgggtgtaaccatgttgtccgcttactttcccgtctttgtctttatcctcatcggcctcgcggccggcgtgctgtttatcctgctcggcacgattttaggcccgaaacgccactatgccgaaaaagacgcgccttacgaatgcggttttgaagcttttgaaaacgccaggatgaagttcgacgtgcgctattacctcgtcgccatcctcttcatcctgtttgatttggaggtcgcgtttatgctgccgtgggcagtcgtgttcaaagatttgggcgcgtacggcttctggtctatgctggtgtttatcgttgttctgacggtaggctttgtttacgaatggaaaaaaggtgcgctggaatgggaatagaaggcgttttgaaaaaaggtttcatcaccaccagcgcggatacggtgctgaactatatgcgtaccggttcgttgtggccggttactttcggcttggcctgctgcgccgtggaaatgatgcacgcgggtatggcgcgttacgaccttgaccgtttcggtattattttccgtccgtccccccgtcaggccgacctgatgattgtggcgggtacgctcaccaataaaatggcgcccgccctgcgccgagtgtacgaccagctcgccgagccgcgctgggtattgtctatgggctcatgtgccaacggcggcggctattatcactattcttattccgttgtgcgcggtgccgaccgcgtcgtgccggtagatgtttatgtgccgggttgtccgccgactgcggaagccctgatttacggcctgattcagctccaacaaaaaatcaagcgcacttccaccattgcgcgtgacgagtaaggagaggacgatatggcaagcattcaagacttatacgaaaccgtcagccgcgttttgggcaatcaggcaggcaaagtcatttccgctttgggcgagattaccgtcgagtgtctgcccgagcactatatttcagtcatgaccgcattgcgtgaccatgaagagttgcatttcgagcttctggttgacttgtgcggtgtcgattacagcacttacaaaaacgaagcatggcagggcaaacgctttgccgtcgtcagtcagttgctttccgttaaaaacaatcaacgcatccgcgtgcgcgtctgggtttcagacgacgacttccccgtagtcgaatctgtagtcgatatttacaacagcgcggattggtacgaacgcgaagccttcgatatgtacggcatcatgttcaacaaccatccggacttgcgccgcatcctgaccgattacggcttcgtcggacatccgttccgcaaagacttcccgatttccggctatgtggaaatgcgttacgacgaagagcaaaaacgcgtgatttaccaacctgttaccattgagccgcgcgagatcacgccgcgtatcgtccgtgaggagaactacggtggccaataaattaagaaactacaccatcaacttcggcccgcaacaccctgcggcgcacggcgtattgcgtatgattttggagctggacggcgaacaaatcgtccgtgccgacccgcatatcggcctcttgcaccgaggtaccgaaaaactggcggaaaccaaaacctatctgcaagccctgccctatatggaccgcttggactatgtttccatgatggtcaatgagcaggcgtattgtttggcagtagaaaaacttgtcggtatcgatgtgcccatccgcgcccaatacatccgcgtgatgtttgccgaagtaacgcgcatcctcaatcacttgatgggcatcggttcgcatgccttcgacatcggcgcgatgaccgccattctttacgccttccgcgaccgcgaagagctgatggacttgtacgaagccgtgtccggcgcgcgtatgcacgccgcctacttccgtcccggcggcgtttaccgcgacctgcccgactttatgcccaaatacgagggcagcaaattccgcaatgccaaagtattgaagcagctcaacgaatcccgcgaaggcaccatgctcgactttatcgatgccttctgcgaacgcttccccaaaaatatcgacacactcgaaaccctcctgaccgacaaccgtatttggaaacagcgtaccgtcggcatcggcgtcgtctcccccgaacgtgccatgcaaaaaggctttaccggcgtgatgttgcgcggttcgggcgtggaatgggacgtgcgtaagacacagccttacgaagtgtacgacaaaatggatttcgacatccctgtcggcgtgaacggcgactgctacgaccgctacctctgccgtatggaagaaatgcgtcaatccgtacgcatcatcaaacaatgttccgagtggttgcgtgtcaatccgggtccggtcattaccacaaaccacaaattcgctccgcccaaacgtaccgaaatgaaaacaggtatggaagacctgattcaccatttcaaactctttaccgagggtatgcacgttcccgagggcgagacctacaccgctgtcgaacatccgaaaggcgagttcggcgtttacatcatttcagacggcgcaaacaaaccctaccgcctgaaaatccgcgcacccggcttcgcccatctgcaaggcatggacgaaatggcaaaaggccacatgctcgccgacgtcgttgccatcatcggtacgcaggacatcgtattcggggaggttgaccgataatgttatccgcagaatctttaaaacaaatcgacatcgagttggcaaaatatcctgccgaccaacgccgctccgcgattatgggcgcattgcgtattgcccaaaccgaaaaaggctggcttgctcccgagaccatcgcttttgtcgccgactacatcggcatcacgcctgcacaagcctacgaagtcgccactttctacaatatgtacgaccttgagcctgtcggcaaatacaaactgaccgtttgtaccaacctgccctgcgccctgcgcggcggtatggctaccggcgaatacctcaaacaaaaactcggtatcggctacggcgaaactacccctgacggcaagtttacccttgtcgaaggcgaatgcatgggcgcatgcggcgacgctcccgttatgctggtcaacaaccacagcatgtgcagctttatgaccgaagaagcgattgagaagaaactggcggagttggagtaggtcgtctgaaacgacgatttaaacgtaggtcggatacttgtagccgacagagtgggtaaaaaggcaaaatgtcggatttaagaatccgccctactgaaataccgaaatgccgtcattcccgcgcaggcgggaatccaccggtaagattcggtttctgaatttaataagacattgcttaccattgaggatggattcccgcctgcgcgggaatgacgacagacaagcaagtggtcgagatccaacaaaaacgattaaaggtcgtctgaaaatatcgatttgataaactagattttatttcagacgacgttacaagccggtacacaaagacatcttaaggtcgtctgaaacagcggccgcaaccgatacgaaaacaaacaggcacaccaaaaatggctatttaccaatcaggcgtgatttttgaccaagtggataccgccaatcccgattgctggacattggacgaatacgtcaaacgcggcggctataccgccctgcgtaaaattctgtccgaaaacatctcgcaaaccgatgtgattgacgaagtcaaaacctccggtttgcgcgggcgcggcggtgcgggcttcccgaccggtttgaaatggagctttatgccccgttctttcccgggcgaaaaatatgtggtttgcaacaccgacgaaggcgaaccaggtacgtttaaagaccgcgacatcatcatgttcaatccgcatgccctgatcgaaggcatgattatcgccggttacgcgatgggcgcgaaagccggttacaactatatccacggcgaaatttttgaaggctaccaacgctttgaggccgctttggagcaggcgcgtgccgcaggctttttgggtaaaaatattttgggttcggattttgaatttgaactcttcgcccaccacggctacggcgcatatatttgcggcgaggaaaccgcattgctcgaatcgctggaaggcaaaaaaggccagccgcgctttaagccgccattccctgcttcgttcggcctgtacggcaaaccgactaccatcaacaatactgaaacgttctcctccgttccattcattatccgtgacggtggacaggcatttgccgataaaggtattccgaatgcaggcggtaccaaattattctgtatttccggccatgtcgagcgtccgggcaactatgaagtgccattgggtacgccgtttgccgaagtcttgaaaatggcgggcggtatgcgcggcggtaaaaaactcaaagccgtcattcccggcggttcgtccgcgcccgtattgcctgccgacatcatgatgcagaccaatatggactacgactcgatctccaaagcaggctccatgctcggttccggcgcgattatcgtcatggacgaagacgtgtgcatggtcaaagcccttgagcgtttgagctacttctactacgacgagtcttgcggccaatgtaccccctgccgagaaggtacgggctggctttaccgcatcgtccaccgcatcgtagaaggcaaaggtaaaatggaagatttggatttgctggattccgtcggcaaccaaatggcaggccgcaccatctgcgccctcgccgatgctgccgtcttccccgtccgcagctttaccaagcatttccgtgatgagtttgtgcattacatcgaacacggcgggccgatgaaagagcataagtggggagggtggtaatggtggaagctaaaatttttattctatacggtgcagccaacaaaggtaagagtacgacactcaatacgctttttaatcagatttgtcggaaattttctaaatttctagtcttttttgaaagacatggaaacggcttagattttgttgcagtatttgatcatgaaggtcagagaattggtttttattcatctggtgataatgaatacgaggttaggggaaatttatacaaactttattcgcataattgtgattttatttttggcacgtcaaggacacggggtggtagttgcgatgcagtaggatgttatgcagagttattgcatggcgatgtaaatataattaattggtgtgaaaagtttgagcctacagatgaagacaatgagcgtgctgttaaagagttatttaagtcatttaaaaatataataaatgagttatagttttagttggttttatattggttaaaagcaaaatgctaaaaatttaactttgccgtcattcccgcgtaggcgggaatccatagtggaatttacagaacccgatatttgaaaagcagttgccgaaattcaaaaaatggattcccgcctacgcgggaatgacggcgggagtaggcagatgttttcagatgaaaacggttgtaaatgatattaaaaaagttgttgtttatattgcaggaaaaatgaatacgaaaccatccgcttactagacaacctgccgtatatattttggcaaacggtaaaaatggaacactctatatcggtgttaccatgaatttgccggaaagggtttggcagcacaaaaaccatgtcaatattgatggctttactgcccgatatgatgtgcatgatttagtttggtatcagttttttgagaatatgcctgaagcagttgccaaagaaaaaacgatgaaaaaatggcgacgtgaatggaagattaaactgattgaagaacaaaatactgaatgattggacttgtcgggcgtgttgtttgtttagttttatttctggaactttaaaaactgtcgttattccagccccacctacgcgcagacaggctacggcgggaatcaccgcaaaagttaagaaaccaatgtttgaaaacagttaccgaaaacccaagaatggattcacgcctgtgcgggaatgacggcaaggtggcagtaaacgttttaaacagtattgattgtcaatgaaactcaaaaggccgtctgaaacccatttttcagacgacctccataaaagattatttatcaaatacccgtaactaggaacgaaccatgttacaaatcgaaatcgacggcaaacaagtatctgtggagcagggcgcgacggtgattgaagccgcgcacaagctcggtacttatattccgcatttctgttaccacaaaaaactttccatcgccgccaactgccgtatgtgtctggtgaacgtagaaaaagccccaaaacccctgcctgcctgtgccacgccggttacagacggcatgattgtgcgtacgcattcggcaaaagcccgagaggcgcaggaaggcgtgatggagttcctgctcatcaaccatccgcttgattgtccgacctgcgaccaaggcggcgaatgccagttgcaggatttggcggtgggctacggcaaaaccaccagccgctacaccgaagaaaaacgttccgtcgtcggcaaagatatggggtccttggtttccgccgaggaaatgagccgctgtatccactgcacccgctgcgttcgtttcactgaagaaatcgccggtttgcaggaaattgcgatggtgaatcgcggcgaacactccgaaatcatgccctttatcggcaaaacggtggaaaccgaattgtcgggcaacgtcattgatttgtgtcccgtcggcgcgctgaccagcaaaccgttccgcttcaacgcgcgtacttgggaattgaaccgccgcaaatccgtttccgcccacgatgctttgggcagcaacctgattgtgcagaccaaagaccataccgtccgccgcgtgttgccgttggaaaacgaagcgattaacgaatgctggctgtctgaccgcgaccgtttcgcctacgaaggcctgtatcacgaaagccgtctgaaaaacccgaaaatcaaacagggcggcgagtggatggacgtggattggaaaaccgcgttggaatatgtccgcagcgcgattgaatgtatcgccaaagacggcaagcaaaaccaagtcggcgtttgggcgaacccgatgaatacggttgaagaactgtatctggcgaagaaactcgccgacggcttgggtgttaaaaactttgcaacccgtttgcgccaacaagacaaacgtctttcagacggccttaaaggtgcgcaatggttgggacaaagcattgaatctttggctgacaacgatgccgtattggtagtcggtgcgaacttgcgcaaagaacagccgctcctgactgcccgcctgcgccgcgccgccaaagaccgtatggcattgagcgtattggccagcagtaaagaagaattgtttatgccgcttctgtctcaagaagccgcacatcccgacgagtgggcaggccgtctgaaaaacctgtctgtcaatgcggaacacgccgttaccgccagcctgaaaaatgctgaaaaagcagcggtgattttgggcgcggaagtgcaaaaccatcctgattacgccgcggtttacgccgccgcgcaagagctggctgacgcgaccggcgcagtgctgggcattttgccgcaagccgccaacagcgttggtgcggatgtcttgaatgtaaactccggcaagagcgttgtcgaaatggtaaacgcgccgaaacaggcagtcttgctgctcaacgttgagcctgaaatcgatacggcggacggtgcaaaagccgtagccgcgttgaaacaggcaaaaagcgtgatggcgtttacgccgtttgtcagcgaaacgctgctggacgtgtgcgacgtgttgttgccgattgcaccgtttaccgaaacctcaggcagcttcatcaatatggaaggccgtctgcaatccttccacggcgtggtacaaggcttcggcgattcgcgtccgctgtggaaagtgttgcgcgtattgggcaacctgtttgacctgaaaggttttgaataccacgataccgctgcgattttgaaagacgcgctggatgtggaaagcctgccgtccaaactggacaaccgcaacgcatggacaggggagggcgttcagacgacctcagaccgcctcgtccgtgtcggcggcgtcggtatttatcacaccgattctatcgtgcgccgttccgcaccgttgcaagaaaccagccatgccgccgtgcctgctgcgcgtgtaaatccaaatacattggcacgcttgggcctgcaagacggacaaaccgctgtcgccaaacaaaacggcgcaagcgtatcggttgccgtcaaagccgatgccggactgcctgaaaacgtggtgcatctgccgctgcataccgaaaatgccgcgctgggtgcgttgatggacactattgaactggcgggagcttgattatgcaggaatggttccaaaacctctttgccgcaacgctcggtctgggcgatttgggtattactgtaggcttggtggtatccgtcatcgtcaaaattgtgattatcctgattccgctgattctgaccgtcgcctacctgacttatttcgaacgtaaagtcatcggcttcatgcagcttcgcgtcggtccgaacgtaaccggcccgtggggtctgattcagccgtttgccgacgtgttcaaactcttgtttaaagaagtaacccgtccgaagctgtcaaacaaagccctgttctatatcggcccgattatgtcgcttgccccgtctttcgcggcgtgggcagtgattccgttcaatgaagaatgggtgctgaccaacatcaatatcggtcttttgtacatcctgatgattacctcgctgtcggtttacggcgtgatcatcgcgggctgggcttccaactccaaatattcgttcttgggcgcaatgcgtgcttccgcgcaaagcatttcctacgaaatcgccatgagtgccgcgctggtgtgcgtcgtgatggtgtcgggcagcatgaacttctccgacatcgttgccgcgcaggcaaaaggcatcgcaggcggttcggtattctcttggaactggctgccgctcttccccatcttcatcgtctatctgatttccgccgttgccgaaaccaaccgcgcaccgtttgacgtggcagagggcgagtctgaaatcgttgccggtcaccacgtcgaatattccggcttcgcattcgcgctgttcttccttgccgaatacattttcatgattctgattgccgcgctgacatcgttgatgttcctcggcggctggctgtctcccttcccgcaaagctggggcattgtcggtacgccttccgcattttggatgttcgcgaaaatggcggcggttctgtactggtatctgtggatacgcgccaccttcccacgctaccgttacgaccaaatcatgcgcttgggctggaaagtgctgattccgatcggcttcgcctacatcgtgattttgggcgtgtggatgatttcaccgctgaatttgtggaaataagtttcagacggcatcttgaggccgtctgaacaaagcgattttgaatacctaacgaaatccctgttttgagggaacataatatggctaacttagtaaaaacctttctgcttggcgaattggtaaaaggtatgggcgtaacgctcaaaaactttttcgcccgcaaagacacaatttatttccccgaagagaaaacgccgcaatccgtgcgtttccgcggtctgcacgcgcagcggcggtatccgaacggcgaagagcggtgtatcgcgtgtaagttgtgtgaggcagtgtgtccggcaatggcgattaacatcgaatcggaagaacgtgaagacggtacgcgccgcaccaagcgttacgacatcgacctgaccaagtgcatcttctgcggtttctgcgaagaggcatgcccgactgatgcgattgtggaaacccatatttttgaataccacggcgagaaaaaaggcgacttgcacatgaccaagccgattcttttggccattggcgacaaatacgaagctgaaatcgccaaacgcaaagccgctgacgcgccgtatcgttaatgctttggggcttcttggaaggttttaaatatggaaggactgattaatgcattgaaatatttagccgaacatgagccaatagataattttgaagaaattagaactagaaatagtccgattgagttgccaagtggattaagtaattttgaacaaaatatttttttaaaagaaaatttatccccaaaattacaaaatgatgatagcttgaagacgcattattggattatccgtgaatggggtgggattaaaagttttaaacaatctgctgaaaatagccagcttattcgtcaatttttatcggaacttaattcgggaaaattgagtagtggtttgttgaaaatttcatcattatctaaattggcttcttttatagattgtgagcgattcgccatttatgattcacgcgctattttttcgttgaattggttgttgtttaaatttacaaatgcagatttgttttttcagccacaaggtagaaatagggaactagaaatccgaaatatgaacgtattgtttcatttttctgatatcaaaccgaattatcggaaaccagacgtttcgtttcatcaatattgtgggttgttacaagatttggcgaaacaagtttatggtaaacaagcaaaaccgtatcacatagaaatgttgttattcaaaattgcgacaacgtggatttgtgcggatatggatcaactgattaagtttgattgtttgcgtaaccaggattttcagactgcttgaaaccatatttttgattaataaagaaagcatagactatgactttccaactgattttattttatatttttgcagtgataattctttatggcgcgctcaaaaccgtcaccgctaaaaaccctgttcacgccgctttgcatctggtgctgaccttctgcgtgagcgcgatgctttggatgctgatgcaggctgagtttttgggcgtgacgctggtggtggtttacgtcggcgccgtgatggtgttgttcctgttcgtcgtgatgatgttgaacatcgacattgaagaaatgcgtgccggtttctggcggcacgcgcctgttgccggtgtggtcggcacattgttggcggttgcgctgatcctgattctggtcaacccgaaaaccgaccttgccgcatttggtctgatgaaagacattcctgccgattacaacaatatccgcgatttgggcagccgtatttataccgactatctgttgccgtttgaattggcggcggtattgctgttgttgggtatggtggcggcgattgcgctggttcaccgtaaaacggttaatccgaaacgcatggatcctgccgaccaagtcaaagtacgcgccgaccagggccgtatgcgtctggtgaaaatggaagcggtcaaaccgcaagtcgaatctgccgaagaaagcgaagtttcagacgacctcaagccgaaagaggagggcaaagcatgattaccttgacgcattatttggtattgggtgcgctcctgttcggtatcagcgcaatgggtatctttatgaaccgcaaaaacgtgctggtattgctgatgtcgatcgagctgatgcttttggcggtgaacttcaactttatcgccttctcgcaacatttgggcgatactgccggacaaattttcgtattcttcgtattgaccgttgccgctgccgaatctgccatcggtttggcgattatggtgctggtgtaccgcaaccgacaaacaatcaacgttgccgatttggacgagttgaaagggtaaaggtaggttgggtcgagacctgacaagacaccgatgccgtctgaaaacccgataggaaaaacgatgaaatccatagacgaacaaagcctgcataatgcccgccgcctgtttgaaagcggcgacatcgaccgtatcgaagtcggtaccaccgcgggcctgcaacagattcaccgttacctgttcggcggcttatatgattttgcgggtcaaatcagggaagacaacatttccaaaggcggttttcgttttgccaacgccatgtatttaaaagaggctttggttaaaatcgagcagatgcccgagcggacttttgaagaaatcatcgccaaatatgttgaaatgaacattgcccatccgtttttggagggtaatggcagaagtacccgcatctggctggatttggtgctgaaaaaaaacctgaaaaaagtcgtgaactggcaaaatgtaagtaaaaccctgtatttgcaggcgatggaacgcagccccgtcaacgatttagaactgcgctttctgttaaaggacaacctgactgacgatgtggacaaccgtgaaatcatctttaaaggtatcgagcagtcgtattattacgaagggtatgaaaaaggctgagggtcgtctgaaaagcgatttcagactgtttcagacgacctgattcggtaggtgatcagacgggagcggatgagaaaagaaattctgggtaagaataatccggtctgaaatattggaagaagaatgatggataaaaatcagttagaacaagaatttcataaagccatgttaaatatttatcaggaggctttgaatttgccgcaaccttacaaggcgacacgatttttacaaattgtaaatgaatttggtggtaaagaggcggcggataaattattgagtacgggggaaaagaagactcagaccggttttacagagctgattttgagtggtggcggagtccacgccttgaaatacagtatggaatatctggtgttacaaaagccgtggtgtgatttatttactgaagagcaattagctgtggcacgcaaacgattggagcgtgttggatttgtttttccgaagtaattttgtacgaaacaaacatagatttttaaatcaatcggattcaatcaaatgaacgatatgactttatatttgataattgcccttgttccgttggcaggctcgctgattgcgggtttgttcggcaacaaaatcggacgtgccggtgcgcatacggttacgatactcggcgtggcggtgtccgccgtgctgtcggcttatgtgctgtggggctttattgacggcagccgcgccaagtttgacgagaatgtctatacctggctgacaatgggcggcttggatttctccgtcggcttcttggtcgatacgatgacggcgatgatgatggtcgtggtaacgggcgtgtcgttgatggtgcatatctataccatcggctatatgcacgatgaaaaagtcggctaccaacgcttcttcagctatatttctttgtttacattcagtatgttgatgctgattatgagcaacaacttcattcagctcttcttcggttgggaagcggtgggcttggtgtcgtatctcttgatcggtttctatttcaaacgcccgagcgcgacatttgccaacctgaaagcctttttgatcaaccgtgtcggcgacttcggctttttgctcggtatcggcttggtgcttgcctatttcggcggcagcttgcgctatcaagatgtattcgcttatctgcccaacgtgcaaaatgccactatccaactgttccccggtgtggaatggtctttgattactgtaacctgtttgctcctgtttgtcggtgcgatgggtaaatcggcacaattcccgctgcacgtctggctgcctgattcgatggaaggcccgaccccgatttctgcattgattcacgccgcaaccatggttaccgccggtttgtttatggtgtcgcgtatgtcgccgatttatgaaatgagcagcaccgcgctgtcggtcattatggtgatcggcgcgattaccgccctgtttatgggctttttgggcgtgattcaaaacgacatcaaacgtgtagttgcgtattccaccctgtcgcaattgggctacatgaccgtggctctgggcgcgtctgcctattccgtggcgatgttccatgtgatgacccacgccttctttaaagccctgttgttcttggcggcaggcagcgcgattatcggtatgcaccacgaccaagacatgcgccatatgggcaatctgaaaaaatatatgccggttacttggctgaccatgctgatcggtaacttgtcgctgattggtacgccgttcttctccggcttctactccaaagattcgattatcgaagcggcgaaatacagcacactgccgggcagcggctttgcctattttgccgtcctcgccagcgtgtttgttaccgcgttttacgcgttccgccaatactttatggtgttccacggcgaagagaaatggcgcagcctgcccgaacaccattcagacggccacggcgaagaacatcacggtttgggtaaaaacgacaatccgcacgaaagcccgttggtggttaccctgcctttgattttgcttgccgttccgtccgtcatcatcggctacatcgccatcgaacccatgctctacggcgatttcttcaaagacgtgattttcgtcaacgccgacgcgcatccgactatacacatcatgaaggaagagttccacggcgcattggcaatggtgtcccacagcctgcattcgcccgtactctaccttgctatcgcaggcgtgttgagcgcatggcttttgtacgtcaaactgccgcacctgccagcgaaaattgcacagacgttccgtccgatttacgttttgtttgaaaacaaatactacctcgacgccctgtatttcaacgttttcgccaaaggcacacgcgcattgggcactttcttctggaaagtcggcgataccgccattattgacaacggtattgtcaacggctctgccaaactggtcggcgcgattgccgcgcaagtgcgtaaagcccaaaccggctttatctacacctacgccgccgctatggtgttcggcgtattggtcttgctcggcatgaccttctggggattgttccgataagaataaggtttcagacggccttaaaccttcaggccgtctgaaacgaagaaatatccacataaacacatttttattttaaccacaggttaaccactatgttttccaactacctactcagcttggcaatatggatacccatcgccgcaggcgtgctggttttggcaacggggtcggacagccgtgcgccgtttgcccgcgtgctcgccttcatgggtgcgcttgccggtttcttggtaacactgcccctgtttaccggtttcgaccgtttgagcggcggctatcaatttaccgagttccacgagtggattccgcttctgaaaatcaactacgcattgggcgtggacggtatttcagtgctctttatcatcttgaatgcgtttattacgctgttggtggtattggcaggttgggaagtcattcagaaacgtccggcgcagtatatggcggcattcctgatcatgtcgggtttgattaacggcgcgtttgccgcgcaggatgcgattctgttttatgtgttcttcgagggtatgctgattccgctgtacctgattatcggtgtatggggcggtccgcgccgcgtctatgcgtcggtcaagctcttcctctacacgctgatgggttcgctcctgatgctggttgcgatggtttacctttattatcaaacaggcagcttctctattgtcgatttccaaaacatcgaacagattccgttgggcgtacaacagcttttgtttgtggcgttcttcctgtcatttgccgtaaaagtgccgatgttccctgtgcacacttggttgccggatgcccacgttgaagcgccgaccggcggttcgatggtgttggcggccattacgctgaaactgggtgcgtatggtttcttgcgctttatcctgccgattatgccggatgcggcacgctattttgcccccgtgatcatcgtattaagtctgattgccgtgatttatatcggtatggtggctttggtgcaaaccgatatgaaaaaactggtggcgtattcgtccatcagccatatgggttttgtaacgcttgggatgtttttgtttgttgacgggcagttggacgactgggcattgaaaggtgcaatcattcaaatgatttcgcacggtttcgtgtctgccgcgatgtttatgtgtatcggcgtgatgtacgaccgcctgcacacgcgcaatattgctgattatggcggcgtggtcaatgtgatgcccaagtttgcggcgtttatgatgctgttcggtatggcgaacgcgggtttgcctgcgacttccggcttcgtgggcgagtttatggtgattatgggcgcggtcaaagtgaatttctgggtcggcgcgttggccgccatgaccctgatttacggtgcatcttataccctgtggatgtacaaacgcgttatttttggtgcgatccacaatccgcacgttgccgaaatgcaagacatcaattgccgcgaatttgcgattttggcaattttggcggtggctgttttgggtatgggcctgtatccgaacgcatttatcgaagtggtgcatcaggcggcaaacgatttgattgcccatgtggcacaaagcaagatttgaggtgtgtaaatgaactggtctgatttgaatttaatgcccgccatgcccgaaatcgtgctgctgtcgctgctggtgttattgttgctggcggacttgtgggtcagtgatgacaaacgcccgtggacgcattacggcgcgttggcaacggtggcggttacggctgtggtgcagttggcggtgtgggaacagggcagcacgtcttcgttcaacgggatgtatattgcagacggtatgtcgcgtttggcaaaaatggttttatatgccttgacctttgccctgtttgtctatgccaagccctacaaccaagtgcgcggtatttttaaaggcgagttttacaccctgtcattgtttgccctgttgggtatgagtgtgatggtgagcgcggggcattttttaactgcctatatcggtttggaactcttgtcgcttgccctttacgccctgattgccctgcgccgcgattccggctttgccgccgaagccgccttgaaatattttgttttgggcgcgctggcatccggcctgctgctctacggtatttctatggtttacggcgcaaccggttcgctggaatttgccggcgtgctcgcctcttccttcaatgaagaagccaacgaatggctgttgaaactgggtttggtgtttatcgtcgtcgccgtcgcgttcaaactcggtgcggtgccgttccatatgtgggtgcccgacgtgtatcacggcgcgcccacttctgttaccgccttggtcggcactgccccgaaaatcgccgccgtcgttttcactttccgcatcctcgttaccgggctgggaaccgtgcatcatgactggtctctgatgtttgccctgcttgccgccgcctcgctgctggtcggcaaccttgccgccatcatgcagaccaatatcaaacgtatgttcgcctattccaccgtatcgcatatgggtttcatcctgttggcgtttatggcgggcgcggtcggctttgcggcgggcctctattacgccattacctacgcgctgatggcggcggcagggttcggagtgttgatggtgttgtcggacggggacaacgagtgcgaaaacatcagcgatttggcagggttgaaccaacaccgcgtatggcttgcctttttgatgctgctggttatgttctctatggcgggcattccgccgctgatgggtttttacgccaaattcggcgtgattatggcactcttgaaacaaggccatgtttggttgtctgtatttgccgtcatcatgtcgctgattggtgcgttctactacctgcgcgtggtcaaagtcatctacttcgatgtgcctgatcatgaccagccggtcggcagcaactatgccgccaaatttgttctgacggtcaatgccttcttgctgctcctgtggggcatcatgccgcaaaccgttatcgactggtgcgccaaggcgttggagaacacgctgtaagccgccgcaacggcagccgtgtcagaggctgccgtttttgttaagatatgccgttccgcaacgcggttcagacggcatcgccgccgacaacgcctaaacagaaagcccaccatgaccgcatccatgtacatccttttggtcttggcactcatctttgccaacgcccccttcctcacgaccagactgttcggcgtggccgcactcaagcgcaaacatttcggacaccacatgatcgagctggcggcaggtttcgcgctgaccgccgttcttgcctacatcctcgaatcccgtgcaggatcggtacacgatcagggttgggagttttatgccacagtcgtctgcctgtacctgatttttgcgtttccatgttttgtgtggcggtatttttggcacacgcgcaacagggaatagacaagcataggaatgccgtctgaaaccctttcagacggcatttgtttcattcaagtgcaggccggcatcgctgtgccggcacgtttcagccggcgatatacgccggttttaatatttgcgggcgactgcaaattctgccaactgccgcaggcgcagggctttgtcgccgaagggttcgagcagcgcgaccgcttcggcaaccagtttgtgtgcgtatgagcgcgccgcttccaagcccatcagtttcacataagtcggcttgtcgttgtctgcgtctttgcccgccgttttgcccaaagtcgccgtgtccgcttcacaatccaacacatcgtcaatgacttggaacgccagccccagttttgccgcgtaagcgtccaatacggaaagttccgcatctgacagatcaggacacgccgtcgcccccaataaaaccgccgcacggattagcgcacccgttttcaggctgtgcatctgttccaaatcggcttgaaccatttgtttgccgacattcgccaaatcgattgcctgaccgcccgccatacccctgctgccgcccgctttcgccaacaccgacaacattgccaactggcgtgcggcgggcagttctgtcggacggctcaacacgtcaaatgcctgtgtctgcaaagcgtcgccggtcagaagggcggtcgcttcgccatatttgatgtggcaagtcggtttgccgcgccgcaggctgtcgttgtccatcgccggcatatcgtcgtgaaccaaagaatagacgtggatcatttcgattgccgccattgcctgttctactgcttcatgcacggcttcgcctaattccgaagctgccagaaccagcatcggccgcagacgcttaccgccgtccaaagccgcataacgcatcgcttcgtgcagtgtgtgcggtatttccccctcagacggtaaaaaccgttcaagcagcagctctgtttgcgcctgcgccctctgttgccacgttttcaaatcattcgtcggattcaaggtttaactccttcagcccgtctgtgtctaaaacctgtagcttttgttcgacttgtgccagtttggtttggcagtacctgaccagttcgttgccttcctgataggcggcaagcgcgtcttccaagggcatttcgccctgcatagactgcgtcagcgattcgaggcgcgacaaggcttcttcaaacgatttcggggcgtttttcttcatcgtatttccttttcggttgaaaccccgccctttagggcggcaggatcagactttatttgggaggggtgtaaccctttccaaatcagggcaatacatagggcggtgctttatgtgccgtcctgtgtgttggaacatagtttcggatgttccggtaaaaagcggattgtagcatttttgaaaaacggatgccgtctgaaacccgaatccggcttcagacggcattttttccgcccaggcggcaaggcgttacccgggcagttcgtcggtgatgccctgcaaaaaggcgaggcgttcggggcttgccgccccggtttgcgcggcggctttgaaggcgcagccgggttcggcgcggtgggtgcagttgtggaagcggcattgcccgacaaggtggcggaaatcggggaaatagcgcggcaaatcggcggcttggaggtggtgtaaaccaaattcttgcaaacccggggagtcgatgagttgggtttcgccgttcaaatcataaagccgggcgtgggtggtggtgtgttttcccgagtcgagtgcggcggaaatgtcgccggtgcgggcggtttggctgcccaaaagggcgttggtcagggtggatttgcccataccgctctgcccgagcaggatgttgctgtgcccttgcagggcggggcgcaggctgccggcgttttccagtgcgcgggtttcgatgacgggataacccagcgtttcgtagaatttgagtttttcgcgccaaagggcggtttcgggcaggtcggctttgttcaggacgatgacggcttcaataccggcggcttcggcggcaagcagggcgcgttgcagcagccgcacgctcggactcgggacggcggcggttacgatgaggagttgggtaacgttggcggcgatgagtttggttttccacgcgtcttggcggtagagcaggctttggcgcggtaaaaaatcttcaatcacaacttgttcggcgttgacggggctgatgcggacgcggtcgccgcaggcgaaatcgacgcgttttttgcgggtgctggcttcgtaggttgtgccgtcgggcgtgcggacaatgtagcggcggccgtagctggcggtaatttgggcggtgtcgttcatggtttctttggggttgggtgtgggaatgccgtctgaaaacgggtgttcggacggcatcggttcagtcgtgctgccactcgacgtgttcgttgaggaagccgccgctctggtgcgcccagagtttggcgtaaagcccgcgtttttcgaggagttcggcgtgtgtgccttcttcgatgatgcggcctttgtcgaggacgacgagcctgtccattgcggcgatggtggagaggcggtgggcgatggcgatgacggttttgccgtccatcattttgtcgaggctttcttggatggcggcttcgacttcggaatcgagcgcgctggtggcttcgtccaaaagaagaatcggtgcgtctttgagcatcacgcgggcgatggcgatgcgctggcgttgcccgccggagagtttcacgccgcgttcgccgacgtgtgcgtcgtagccgcgccgccctttggcatcggaaaggtcggggatgaagccggcggcttcggcgcgttcggcggcagaaaccatttcggcatcggtcgcgtcggggcggccgtaaataatgttgtcgcgcacggaacggtgcagcagcgaggtatcttgcgtgaccaaaccgatttgggcgcgtaaagattcttgggtaacgccgcttatgtcctgcccgtcgatcgaaaccgtgccgctttgcggttcgtagaagcgcaaaagcaggttgacgatggtggatttgcccgcgccgctgcgtccgatcaagccgactttttcgcccgggcggatggtgaggttgaagccgttgagcagcggtttgcccgcttcgtaggagaaatcgacgtgttcaaatttgattgcgccttgcggcacgttcagcggcagtgcccggggcttgtcgaggatggtgtgcggtttggacagggttgccatgccgtcgccgacggtgccgatgttttcaaacagccgcgcggattcccacataatgtattgcgacaaaccgttgacgcgcaacgccatggcggtggctgtagcaaccgcgcccacgccgacctgcccgttgtgccagagccagatgcccagtgcggcggtggagagggtcagggaggtgttgacgatgaagctgcacgaatgcagcagcgtcgccagccgcatttgggcgcgcaccgtaaccataaattcttccatcgactgcttggcataggcggcttcacgcgcgccgtgggagaagagtttgacggtggcgatattggaataggcatcggtaatgcggccggtcatcagcgagcgggcatccgcctgccatgcggcggtttgccccaatttgggaatcagcaggcgcatcaccgaagcgaaaccgacaatccagccgataaagggcagcagcagccatgagtcgagcgaggcgagaatcacgccggaggtaatgaaatacaccgacacataaacgaccatatcggcaaccgtcatcaccgcgtcgcgcaacgccagcgcggtctgcatgactttggcggacacgcgtccggcaaattcgtcctgataaaaaccgaggctttggttcagcatcaggcggtggaagttccagcgcaggcgcatggggaacacgccctgaagggtttgcaggcgcacgttggacgcggcaaacgcccacgcaaccgaaaataccatcatcgccgccattgccgccagttcccaacttttttcggcaaacagttcggcgggcgcgtatttgccgagccactccacgattttgcccataaattgaaaaaccagggcttccataatgccgatgccggcggtcagcgcagccagggcggctatccatttccgcacgccggccatgctgctccagacaaaccgccacaagcctttttctggcgttttcggggcggcttcgggataagggtcgattcgggactcgaaccaggaaaatattttgttcaacattgttttcgatttcggtaaaacagtttcagacggcatcaaacacaatgccgtctgaaaggaaggacaataacgccattttacgggaaaagccgtcgggaagacagcgcgaggcggaaacgcagggtttcgtcagggcaaacgccgcgccgccttcaggcggcattatttcagcaggtttttcaaagcaaggcgcacgccttcgcccacgtccgtcccctccggaacgcctttgaccgccgcttttgcttcgcgttcgctgtaacccagcgcaagcagcgtgctgacgatgtcttccgtttcgtcggcggcgggtgcggcggcaaacagcccgtccgttaccgtatgcgcgaccagcttgccgcgcagttccaaaaccatacgttcggcggtttttttgccgattcccggggcggaggagaggcgtttgacatcttcttctgcaaccgcccgcgccagttcgtcggcagtcattgccgacaaaatgcccaaagccgttttcgcgccgatgccgccgaccttgatcagttggcggaaggtcttgcgttcttccgcagtggcaaaaccaaataaaagatgtgcgtcttcccgaatgataagctgggtaaacagttgtacgctttcacccacgggcggcaggttgtagaaggtctgcatcgatacgtcggcctcatagccgacaccgttgacatcgatgacgatttgcggagggtttttttcaaccagtttgccggtcagtctgctgatcatgtgtgccgaatcctgaagtgtcgggtgcaaaatgccgtctgaaaccggtttgggcttcagacggcacggattgtatcaaattcagtcgtcgcggcgggaggaaatcacgcggccggtacgggcatcgacaacgactttgtattcctgtccgtttttgacgatttcgacatcatagtgcggacggccgttgtcgtgttcgagatcgatgtcggtgattttgccgccgacacgcgccaacgctgctttttcggcttgggcgcggctgatgattttgtcttgtttgttgtgttggtgtgcggcgtgtccgtggtcgtcatcgccgtgtccgtcgtggtgggcgagcgcgggggcggaaatgctcagcagtgcggttgcggcggaggtcaagagaaggtgtttgatgttcatattttgcctttgtaaatcgtgggttggaaaatgtggatattaataaggtatcaaataaccgtcagccggcggtcaataccgcccgaaccataccgcgcgcctgagcttcggcttcggcggcgcgttcctgcgaggtaaacggtcccattttgacgacgtattcgtaacggcgtttttcaaccgagaggttcgtacccgatgacgaaacggcgaagttttgggcggcttggttcagataggcttgtgcttcgtgttccgtaccgaaagatttcaagtcgataaagatgtctttgttttcggcaaccggtgcggattggcccgggacgatttgttcgattttgacgtgtgccgtcccttggttgacaaagcccaatttttgcgcggcggctttggatacgtcgatgatgcggttgccgtggaaggggccgcggtcgttgacgcggacgatgacgcttttgccgtttttggtattggttacgcgcacatagctggggatgggcagggttttgtgggcggcggtaaaggcgttcatatcgtatcgttctccgccggaagttttgcgcccgtgaaacctgccgccgtaccacgaggcgttgccggtttgcgtgaattcggcgacttggtttttcggcgtgtagcgttttccggcgactttgtagctgcggttggcggaggcgtgcagtttttctgccttgaccactgcgtcggcggatgccgtctgaagggagtgtgtgccgaatgcggcggtgagaaggaaaagggtttttcgggttaaagtcaaaacgtgttccgttcttgagttgaagacgaatgggcatcatgcccgccggatacgttccgaaccgccgtacagtgcggacggcggttcggaatgtgtccggataggttttcagacggcatgaacctgcgttcaaacgccgcctgcgtaaccgtgttgccgccacgcttcaaagagaatcacggcgacggtgttggaaaggttcatactccggctgccgggctgcatcggcaggcggattttttgcgcggcgggcaggctgtcgaggatgtcggcaggcagtccgcgcgtttccggcccgaacagtaaaacgtcgcctttttgaaacgcggtttcatcggggcgcgccgtgcctttggtggtcagggcgaaaatgcgcctgcctgcgagtgccttgaggcagtcgtcgaagttttcgtgcaccgtcaggctggcgaactcgtggtagtcgagcccggcgcgtttcattttggcggaatccaatgggaagccgagcggtttgacaaggtgcaaatccgcgccggtattggcgcacaggcggatgatgttgcccgtgttcggcgggatttccggctggtataaaacgatggtaaacataaatatcaatcacttataggcgcgtaaccttgccacaaggcggatggggtgtcaaaaaatttagttattttttcattggcgtgcgtgccagcgtccagcagcagattcggtttgcgcccgattttttcagcgtctttgccaattcgtccagcgtcgcgccggtggtaaagacatcgtcgattaacagaatattacagttttccggtatcggtgtgcggatttcaaaggcgtttttgatgtttcgccgccgttcgccgcctttgagcgtgctttgcggcgggcggtggtgtcggaaaacggtgtgtcggggcagtatctgccagccgtagcgttgtgccagcagcccgacgatgctttcactttggttgaacccgcgttgcagcagccgctccctgcttagcggtacgggcaggacgaaatcgaaacattcgtctgcaagccggtcgggcggattctgcatcatcaggtctgccagcggctgcaccatgctcaaatcagccaagtgcttcagcgcgtgtatcatattgctgacgggcggttcgtaatgcagcgaagcccacatccggtcgaatgcgggcggttttttctgacagccgccgcacaccgatccgccttggatgtgtctgaaacacagggggcagctgtttgccgcgtcggtgcggtatgccgccaaatcgtcgcggcagccggcgcagatgccgtctgaaacgccagacgaaccgtggcataatacgcaacgcctgatagtgggcgcgtctgcgatgcgccgccaacgagagagaaaatccatgcctgatgccgtcaaaaaagtttacctgatacacggttggggggcgaaccgccacatgttcgacgatttgatgccgcgcctgcctgcaacgtggccggtgtccgccgtcgatttgcccggacacggggacgctccgtttgtccgacctttcgacattgcggctgcggccgacggcattgccgctcaaattgacgctccggccgacattctcggctggtcgctcggcggattggtcgcgctgtatctggcggcgcgccatcccgacaaagtccgttcgctctgcctgacggcgagtttcgcacggctgacggctgacgaagactatcccgaagggcttgccgcgcctgcattgggcaaaatggtcggtgcgttccgttcggattatgccaaacatatcaaacagtttctacaattacagcttctgcacacgcctgatgcggacggaatcataggcagaatcctgcccgatttggcgcgctgcggcacgcctcaagccttgcaggaggcgttggacgcggcggaaagggcggatgcgcggcatttgttggacaagatagatgttccggtactgctggtgttcggcggcaaagacgcgattacgccgccgcgtatgggtgaatatctgcaccgccgtttgaagggcagcaggttggttgtgatggaaaaggcggcgcatgcgccgtttttgagccatgcggaagcgtttgccgcgctgtaccgcgactttgttgaagggggtttgagatgaaccatcaggacgcacgctggcaggttcaccgccatcttgccgaacataccgaccaacggctgacactcgtccgcaacgcgcccaagcatatcctgcttgccggtgcggatgcggacatcagccgcagcctgctggcgaaacgctatccgcaggcggtatttgaagaatacgattcccgtgcggattttttggcggctgccgctgccgcccgcaaaggcggtttttggcaaaggtttacgggtaagggcgtggtgcaacactgccaatccccgatcgcgccgctgcccgaagcgtgtgccgatatgttgtggtcgaatctcggactgttggcggcggaacaaatccttcctgtgctgcacaactgggcgcgcgccttgaagacggacgggctgctgttttttacctgcttcgggcgagataccttggcggaactgaaatgccgtctgaaagaaaacggcattgaaagccgcagcgcgcttttccctgatatgcacgacttgggcgatatgcttgctgaaaacggcttttacgaccccgttaccgatacggcgaagctggtgttggattacaaaaaggcggaaacgttttgggcggatatggacacgctgggcgtttggcgggcgatggcgtggaacgatgaaaacgccgcgcgttcgtgtgtcgggacaatatttgagcgggaaggcggtttgggcattacgctggaaacggtgtacggacacgccgtgaaaaaactgatgctgccgcaaggggagaacgtggtgcagttttttccgaagagatgatgtgcagatgccgtctgaagccgtttccaggtttcagacggcatttgtctgtgaaaaccgacagaaataaaggaaatgccgatgtatagtgaattaaatttaaaccagtacagcgttgcctcgccttagctcaaagagaacgattctctaaggtgctgaagcaccaagtgaatcggttccgtactatttgtactgtctgcggcttcgccgccttgtcctgatttttgttaatccactatatgctgatgccggagacgtatattgcgtctataacatcagactgaagcagtacactgcctgccaggttacccgagttgaagaacacggtggcaaaaaaaacacatgcgaccctgctggctttggactggcagggcaacaaaccgcttggggcggaggagctggcggatttgaaatcgctttacaaagacttaaagaataatattggaaatattgtatgaacaaaaaattaaactatatttttatgttggactgtttagggttggtgatattgtttacttgtataatagctacttttgaaagagattatggatttaaaatttttactaattctaagagacctgaattttattattggattggaatgttttattatggaattatttcttgctggtttgattatcaattaatttcaacaaaggcgaattcgtataaaagaaaagttaaacaatataaaattttttcagtaatattttcagttttgatatttatttctactatagtaaaactttaaattttggagcaaaaatttatgagcgattcaattgaatatgtattgggaacgcggtctgcacatgtataaggcaagtgccgtcgtgccgacgggatatgtacgggttgggaataccgcgccgctggtcggcgaagacacgcaacggtatgcctctttttggggcgacggctacgacgtgtaccgtcagttgagatggcagcagatacccgaaaaacagagaaaggcattcaaaaaagccgccaaaagcaaaaagaccgtgatgtttgccggacgggaatacggcatatccaaacagaatttgagcgatgtttgggatgattttgaagacgcgatggaactgaaggcgtttccctgcctgtcttcgctgtttctgaccaaatggcataaaaatctatatgatagtggattaacaaaaaccagtacggcgttgcctcgccttagctcaaagagaacgattctctaaggtgctgaagcaccaagtgaatcggttccgtactatttgtactgtctgcggctcgccgccttgtcctgatttttgttaatccactataaaaacaggaatttttaaatagaggcaatgccgtctgaaacttggtaacgggcttcagacggcatttcgttccaataccgccaacaccgccgcaccgtaacgtgcggctttttcttcgcctacgccgtatacggcggcaagctccgccaagccttccggctgtttggcggcaatggcgcgcagtgcggctttgctgagaatgcggtagggttcggactgttcgtgttttgccgtttcgccgcaccattggatcagggcgcgcatcaggcggcgtttgcgtttggcggtttcatcgatgccgtctgaaaacggacggcagacggcgaggatgtcccgtccgtatttggcggcgcgtacgctgcccaagccgtacacgccttcgaggtcggtttcggtttcgggcgtatcggcaagcatatcggcaaggctttcgtcggagaggacggcatgcagggcgcagttttccgcccttgcctgttcataccgccaggcttcgagtttttgacgcagttgttgttcgcgttcggtttgcggacggatgaccgcgtcgcggctgaagccggcggcgttgcggcagacttcgaggatgccgtgtccgaaacggtcgattttggcttcgcccaaaccgtagatgtcgtgcagaccgttgaggtcttgcggcattttttcgacaaggtcgcgcagggttttgtcgccgaaaatcatataggcggggatgccttcggcttctgcctgtttcatacgccaaacgcgcaatgcctgccacaggcgttcttcgcgttcggtacgcagccagttgtctttgagggtgcgggcggcgggcttgtcgcgcttgagcggacgcagcatcacttcggtttcgcctttgaggacttttttggcggcttcggtcagttgcaatgcctgatatcgggtaatgttgacggtgaggtagccgaggctgatacactggcggatgacgctgcgccattctttgtcggacaactccgtaccgatgccgaatgtggacagttgttcgtgccggttgccgcgtatccaatcgtcgcttttacctcgtaaaatgttggtgatgtaaccggcggcaaaacgttgtccggcgcggtacacgcagctgagtaatttttgcaccaacaccgtgccgtcaaaccgtacgggcggatgcaggcagttgtcgcaatggccgcagggttcggatgcttcgccgaaatgtttgagcagcagtacgcggcggcaggcggcggtttcgcagacggcaagcatggcatcgagtttttgcatttcgatttgcttttgcacctcgtcgctgttgccttcggcaatccgttcgcgcagcaacacccaatcgttcaaaccgtaacacagccagcttgcggccggcagcccgtcccgtccggcgcgccccgattcttgatagaaatgttcgacactctggggcatatcgagatgggcgacaaagcgcacgtcgggtttgtctatgcccatgccgaacgccacggtcgccaccacgataatattgtcttcatgcgtaaagcggcgttggttttcctcgcgtacgtccatgctcaaaccagcatgatacggaatcgcgtttaatccgttttcacgcaaaaactgcgccacatcttccacctttttgcggcttaggcaatacacaatgccgctttgccccgtcatttctttgcggatgaaatccagcaattgttttttgccgttgtttttttcgataacctgataataaatattcggacggtcaaagctggagacaaattcgggcgcatcgtccaagtgcagataatgcttgatgtcggcgcgcgtggcggcatcggcggtagcggtcagagcgatgcgcgggacgttcggatagcgttcggcaagcatgccgagctgttgatattcagggcggaaatcgtgtccccattggctgacgcaatgcgcctcatcaatggcaaacagactgacggtttgttggtcgagaaaacgcaaaaagcggtcggtaaccaagcgttccggcgcgacataaagcagcttcagacggccttgggcaagccggtcggcaatctcgcgcgcctcgtctgccgatgtgccgctgttgactgccgccgcttcgatgccggcggcgtgcaggtttgccacttggtcgttcatcagcgcaatcagcggcgatacgacaaccgccacgccttcgcgcatcagcgcgggaatctggtaacacaaagacttgccaccgcccgtcggcatcagcaccgtcaaactcccgccgcctgccaaagtattgatgacagcctcctgcctgccgcgaaattcgggataaccaaatacttcgtgcagaatctgtttggcggtcggtcggtgcatgatggttccgtgctcggtaagggtgttgatcggtcggcggcaatatgccgtctgaaatcgggatttagaatagtttgcccacttctgcttcaatatcgtcggcacgcataaacgtttcgccgatcaggaaggtatgcacgccgcgcgattgcataaattccacatccgccttgcctgtaatgccgctttcggtaacgacggttttgccttccagcgcgggcagcagcgacagggtttggtcgagggagacttcaaaagtcctcaggttgcggttgtttacgccccacagcggcgtggtcaggttgcggcatttttccaattcggtttcgtcgtgcagctcgagtaggacggtcatgcccaattcgtgcgccaccgcttcaaagcgttccaattgttcctgttccagtgctgcggcaatcagcaggacggcatccgccccccatgcgcgcgcctgataaacctggtattcgtcgatgatgaagtctttgcgcagcacgggcagcgatacggcttcgcgcgcctgtttgaggtattcgggcgaaccttggaaatagggttcgtcggtcagtacggacaaacacgccgctccggcgttttcataggcgcgtgcaatctcggcagggcggaagtccggacggattaaccctttgctcgggcttgcctttttgatttcggctatgacggcgggcaggtttaggcggtgtttgccgcgtatcgaatcgatgaagctgcggacgggcgcggcttctgcggcaagtgtgcggatgtgttcggcgttgacggcggctttttgagcggcaacttcctgtgctttggtggcaaggattttattgaggatgtcggtcatgtcgggttccgtattcgtctggggaaagggggaatattagcatcaaaccgttaacgcctgtttgtgcggaagctgtcgaaataggacaggacggtctgcggcagccattgcaggtgcagcctgccgccggtgctgctgacaaagccgacatgaccaccatatgccggctggaacagggtaacggcttcggatacttcgtctgcgcggggcagggcttcgggcggcaggaaggggtcgttgacggcattgagcaggagcagcggtttggcaacgtgtttgagcagcggtttgcaggaagtttggcggtagtagtcgtgccggtcggcaaagccgtgcagcggtgcggtgaagcggtcgtcaaactcgcccagtgttttgcaccctgcggcaaatgccgtctgaaaaccttggagcgattttgctttgggtatcagggtgcggaggaagtagcgcgtgtagagcagccgcgtgatgccgctgtcgaagcgtctgcctgccgcctctgcatcgacgggggcggagatgacggcagcggcttgcggcaatgcctttttgccctgttcgcccaaatattttgccagcgcgttgccgcccagcgatacgccgacggcgtatatttcacggtaacgcgcggcgaacgtgtccaaagtaaaggcgatttcggcggtatcgcccaagtggtagaacaccggagcggtgttggcaatgccgccgcagctgcggaaatggacgactacgccgtgccaaccccgatcgcgtaccgcaagcatcagttcgaccgcgtaatggctgcggctgcttccttccaaaccgtgaaacagcacgaccagcggcgcatcgggcgaaatgccgtctgaaaagtcgtaggcgactttggttttacccgtgctgtcgggaagcagctctcggcggtatgcgggcgcggggcgttgcaggaatttggcggcaatcgtgtcggcattgccgttgcggaggaaaaagggcgtgtccggcggtgttaaaatcataaggtatcggttttcttgttttcagacggcattgatgatgcggcagcccgtccggctggtgcggacgtgggggatgcgcgcccgaatataggcgtggaaaagcgtttgccgaaaaaggatatcggcatcggtcagttttccacgcgtttgaaatggcgcggacggaagcccaaagccgccagtgatgcgaaatacagtccgccgccgacggcaatcaggatgcagagctgccccgctttccgcattccgccggcgtgcgcccattcaaacggcaggtaagcctgcgctgcccacagtccgccgcacatcacggcgagcgagagcagcatttttgctaagaacgctgcccaacccttgccaggttggtaaataccgtgtctgcgcaacaggtaaaacaacaatccggcattgatacacgcgcccagaccgatggcaagcgaaagtccgacgtgtttcagtgggccgataaaggcaaggttcatcaactgcgtgcagatgagcgtgaagatggcgattttgacgggcgttttgatgttttgccgcgcatagaagccgggtgccaacactttaatcatgattaagccgattaaaccgaaagaataggcaatcagcgcgtgttgcgtcatctgcgcgtcaaacagcgtaaattcgcggtacataaacagcgtcgccaccagcgggaacgacaacaccgccagtccgaccgccgccggcagcgtcagcagcatgcacaggcgcaaaccccagtcgagcagggcggaaaactgttccgtatcttggtttgccgagtgtttggacaaagtcggcagcaaaatcgtaccgagtgccgcccccagcacgccgctgggcagctccatcatgcggtcggcgtaatacatccatgaaacgctgcccgattgcagataagacgcgaaaatcgtgttgatcaccaaagaaacctgcgccacgctcacgcccaaaatcgcaggcgccatctgtttcatcacgcggttgaccgccgcatctttgaaactcagtttgggcagtttcaaaaagcccagtttcgccagccagggcagttggaagccgagttgcaaaatgccgccgacaaagaccgcccacgccagcgcggtaacgggcggatcgaaatacggcacgaaaaacagcgcgaatacgataaacgacacgttcagaaacgtgggcgtaaacgccggaatgccgaacttatgataagaattgagtaccgagccgacaaatgaagacagggaaatcaataatatataaggaaacgtaatccgcagcaaatcgatggagagctgaaatttgtcggcatcttgggcaaaaccgggtgcggaaacataaatcacccaaggcgcggcaagtatgcccagcgcggtaacgataaccagtacaaacgacagcatccccgccacatggcggataaaagcctccgccgcctcttttgaacgcgtttccttgtattccgccaaaatcggcacaaacgcttgggcaaacgccccctccgcaaacacgcggcgaagcaggttgggcagtttgaacgcgacaaaaaacgcatccgtcgccatacccgcgccgaatgcccgcgcaatgaccgtatcgcgcacaaatcccaaaacgcgcgacaccatcgtcaggctgccgacttttgccaaagctcccagcatattcatcattgttcctcaacagtcgtacccgtctggggcaacggcgcgtattgtacgacagaaaccgcttcagacggcatcgggtttgatgccgtctgaagcggtttcctgaaacgaaaacgtccttttccggcggcaaactgtatcaatacgcggaaatgcaataaaatagccggattccgattgatttccaacatctgtttccaacatcacggagaaccgtatgaaatccagacaccttgccctcggcgttgccgccctgttcgcccttgccgcgtgcgacagcaaagtccaaaccagcgtccccgccgacagcgcgcctgccgcttcggcagccgccgccccggcagggctggtcgaagggcaaaactataccgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctggcacgcctcgccgccgccgtcgatatggctgccgccgacagcaaagatgtggcgaacagccatattttcgatgcgatggtcaaccaaaaaatcaagctgcaaaatccggaagtcctcaaaaaatggctgggcgaacaaaccgcctttgacggcaaaaaagtccttgccgcctacgagtcccccgaaagccaggcgcgcgccgacaaaatgcaggagctgaccgaaaccttccaaatcgacggtacgcccacggttatcgtcggcggtaaatataaagttgaatttgccgactgggagtccggtatgaacaccatcgaccttttggcggacaaagtacgcgaagaacaaaaagccgcgcagtaagcccgtttgaaaaatgccgtctgaaacttggttttcagacggcattttgattgggtttaaaacgtaaagcccgtttccagttcttcatcgccgaccagttcgaccaagagcgcgtagagcggggcgagttcggcataacggcgcgatacgcggcgcagatagtttaagaaacgcgggatttccggacggtatttgtctttgccgtcgcggtagtacaggcgtgcgaagatgcctgcaaccttcaagtgccgctgcacgcccatccattcgaaccagcggtaaaactcgtcaaacgcttcggggacgggcaagccggcagcccgcgccttttcccagtagcggataaccaagtccaagacaaattcttcttcccattcgataaaggcatcgcgcaacagcgacaccaaatcgtaggaaatcgggccgtaaagcgcgtcttggaagtctaaaacgcccggcctgccgcgcgtcagcatcaggttgcggacgataaagtcgcggtgcacatagactttgggctgcgccaacaggggcggcagcagcgtatcgacggtttgctgccaaagttggcgttgtttgaatgttaattcgcgccccaattcttttgcgacaaaccattccgggaacaggttgatttcgcgcaacatcgtttcacggtcatattcgggcaaaaccccttcacggctcgccttctgcaattcgaccaactcgccgattgcctccaaaagcagggctttgtgcgccgtttcgccctgttcctgaagcattgcggtcaaaaacgtcgtattgcccaagtcgttcaataccacaaaccccagatccgtgtccgcgtgcaatacctgcggcacattgaccatgtcaaacagtttctgcactttcaaataaggtgcgacactcatcttgtcgggcggtgcatccatgcagacgacactgctgccgtctgaaaacgttgcacggaaatagcggcggaaatcagcatccgccgccgcaaaagtcagatcgaagtcccgttcgggataaacggtctgaagccaatttttcagtttgatttgtcgttgcataacagtactaaagcatttcaggttacaataaacgctattctaactggcaaaccgacttgaggggcgattttggctcgtttattttcactcaaaccactggtgctggcattgggcctctgcttcggcacgcattgcgccgccgccgatgccgttgcggcggaggaaacggacaatccgaccgccggagaaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctgaccgtcggaaacctggcaggagcaccgttcccgcacaagacggcattccaccgacaaccccaaacccgccatcaaaggcaggattcaaacgataaggaaagaatgatgaaaatcaaagccctgatgattgccgccgcattgctggcagcagccgatgtccacgccgcaccgcaaaaggcaaaaaccgcatccgccaaagctgccaaagctgccaaagctgccaaagttgccaaagttgccaaagttgccaaagttgccgccacggcgcaaaaagaagccgcacccgcacaacagcagggcggtatccgcttttcagacggcattgccgccgttgccgacaacgaagtcatcacgcgccgccggcttgccgaagccgttgccgaagccaaagccaacctgcccaaagacgcgcagataagcgaatccgagctgtcccgacaggtgctgatgcagcttgtcaaccaatccctgattgtacaggcgggcaaacgccgcaacattcaagcaagcgaagcggaaatcgatgccgtcgtcgcaaaaaatcccgccctcaaaaacctcagccccgcccaacgccgcgattttgccgacaacatcattgccgaaaaagtccgccagcaggcagtgatgcagaacagccgcgtgagcgaagctgaaatcgatgccttcctcgagcaggcgcaaaaacaaggcatcaccctgcccgaaggcgcaccgttgcgccaataccgcgcccaacacatcctgattaaagccgacagcgaaaacgccgccgtcggcgcggaaagcaccatccgcaaaatctacggagaggcccgcagcggcacagacttttccagcctggcgcgccaatattcgcaagacgcgagcgcgggcaacggcggagatttgggctggtttgccgacggcgtgatggttcccgcctttgaagaagccgtccacgcgctcaaacccggacaggtcggcgcgcccgtccgcacccaattcggctggcatatcatcaaattgaacgaagtgcgcgatgccggcacacctcaggaacgtatccgcaattccgtgcggcaatacatcttccaacaaaaagccgaacaggcaaccgtcaacctgttgcgtgacctgcattccggcgcgtatgtcgacatccgctaaggcggtttgaagcaaaaagccataccgatcggcaaaaatccgggcggtatggctttttggatttcgagttacttttacaccgtcattcatcattcccgcgaaagcgggaatctagaaacgaaaagtaacaggaatttatcgggaatggctggagtttaaaggactggattcccgccgtcgcgggaatgacgggattttgggttgtggtaatttatcggaaaaacaaaaaaacctatgccgtcattcccgagcaggcgggaatccggttatttaaaactgcagaaatttatccgaagcaacaacaatctttccatcgtcattcccgcgtaggcgggaatctaggacgtagaatctaaagaaaccgttttatccgataagtttctgtaccgaagaatctggattcccgctttcgcgggaatgacggcgcataagttcccgtgcggacagacctagattcccacctgcgtgggaatgacgattcagaagttgcctgaaacctaaaaaactgaaaccgaacgagccggatttccgctttcgcgggaatgacgggattttgggttgtggtaatttatcgggaaaacggaaacccctatgccgtcattcccgcgcaggcgggaatctaggacgtagaatctaaagaaaccgttttatccgataagtttctgtaccgaagaatctggattcccgctttcgcgggaatgacggcgtataagttcccgtgcggacagacctatattcccacctgcgcgggaatgacgattcagaagttgcccgaaaccaaaaaactgaagccgaacggtctggattcccgctttcgcgggaatgacggcgcataagttcccgtgcggacagacctagattcccacctgcgtgggaatgacgattcagaagttgcccgaaaccaaaaaactgaagccgaacggtctggattcccgctttcgcgggaatgacggcgcataagttcccgtgcggacaggcctagattcccacctgtgtgggaatgacgattcagaagttgcctgaaacctaaaaaactgaaaccgaacgagccggattcccgcttttacgggaatgacgggattttgggttgtggtaatttatcgggaaaacggaaacccctatgccgtcattcccgcgcaggcgggaatctaggacgtagaatctaaagaaaccgttttatccgataagtttctgtaccgaagaatctggatttccgctttcgcgggaatgacggcgcataagttcccgtgcggacagacctagattcccacctgcgtgggaatgacgattcagaagttgcctgaaacctaaaaaactgaaaccgaacgagccggatttccgctttcgcgggaatgacgggattttagattgcgggtatttatcgggaacggcggcttggaagttcattgaaacggaaaaacaacggaaacccaaaaaaccggattcccgactgtgggaatgatgagattcaggtttctgtttttgccggagtttgccgtatcgggcttcagacggcattgcctgccgttgtacccgcgggtgcgactgccttgatgtagttgagcgagacaaactgcttctcggcatccaattcggtgattttgaacaatgcctgtgatttgggcagtgcgtcaaacggaataccggtcgcgcgcgtgaccagcggcaggccttcgatgcggacgaggtcttctttgaggatggtcgcggtcagctcgcttgtaccttgctgttgcaggtacacaaggctccagtaggcttccatctgccgttggaaatcggcgtaggcggtataggcggcatcaaagtcgcgcagtgcggcgaaaagctcggcatcgctgttttgatacagcggctcggcagtgtcgtctatcaggctgatcagctgcttttggttgatgtagtcggcggcgcggcgcagcggcgaggtaaaccagccgtaatgctgcacgcccatgccgatatgcggctcggatttggtgctcatgcgtacttttccggtgggttggacgcggaagaggccgggcaggtcgttgtcatggagcatttgtgcccaagtgctgttggcaagaatcatcatctcgctgaccagcgtatcgatgggtgagccgcgttcgcggcggacgacggataccttgccttcctcatccaattcgatgctgtaatcgtattgcggcgcgcggtcgggttcgtatttgccgcgcgctttttgcagggcggtggcgaattgatagaaccaaatcaggtcttgatggtgggcgaacatcatttcgccggcttcgtccaagccggtttcggcgttgaaatgcggctcgatggcttggatacgcaggtttgtggcgatgttgaccgcttcgattttgcaggtcggcgcgccgacgttgaactcgccgtccacatcgaaataaatgctgacggcagggcggtgtgcgcctgcatcaaggctgaacgcggcaatccagttttcgggcagcatcgtgattttgccgccggggaaataaaccgtgctcaagcgttccatgatgtttttttccattttgtcgcccggtttaacggcaagtgacggcgcggcgatgtggatgccgacacgcttcgtgccgttgtccaagtcggtcaggcttaaagcgtcgtccacttcggtggttgattcgtcgtcaatggaaaaggcggtaacgtcggccttgggcaggtcgggcatttcgggaagggcaaggtcggggaagcctgttcctttagggaagtatttgatttcaaacccgtcttgcaggtattggggaatggacgtaatgccgcccgtttttttcgccaattcgtaggcagaggttttcagcgcgtcggcggctttggtaaaggctttgtaggtcagcgactgcttgtcgggcgcgtgcaggatggttttcaaatccgccgcgatttcagacggcatctcgccgcgtttcaaggcttctgcccaagcgtcgatttgcgcgtcttgctgttttttgcgttcgatggcggcaagtgcttgttttaaagtttcttcgggcgcggctttgaacacgcctttggcttttttgtagaaatacatcggcgcggcgtaaagcgcaatcaaagttgccgccagctcggttttggtcggcgcatggccgtaatattcttcggcgatggcttcggcggtaaattcctcttcgccgcatacttcccacaataaatcggtgtcgatgtccgccgcctgtgcctgcgcgttttccaaaaacgccgccatatcgccgtcaaactcggcaaagacgttgttcgccttcactttggtgcgtttgccgtgtggggtatcgacttggtaggtggcatcgtttttttggatgatggcggcgattttgaattggccggactcttcgtaaaaaatattcatttttcggatttttctgtggaaactcaagcgggcgattttagcagattaccgaaaatgccgtctgaaaaaaggttgggagagggttggcgcggctttgcggtgcttgcgttatagtggattaacaaaaaccagtacggcgttacctcgccttagctcaaagagaacgattctctaaggtgctgaagcaccaagtgaatcggttccgtactatttgtactgtctgcggcttcgtcgccttgtcctgatttttgttaatccactatacgtttttgacggtgtacaatcgctgtttttgaacggaggatggaatggagaatacaaaccgtgtgccggagcaggcacgttatgatgccgaacgcaggcaggcagacgaagcattggcgggcgtgtttccggcagtcagtatcttcggcagcgcgcgcacgccgcagaatcatgcggattatgcgttcgcctgccgtctggcgcggcggctgtcggattcgggcattgccgtcatttcgggcggcgggccggggattatggaggcggcaaacaagggcgcgtttgcagggaagtcggtttcggtggggctgaacatcgttttgccgcacgagcagaaaccgaatccgtatcaggacatcgccttgcggttttcccgttttgccgaacgcaaggcggtgtttttccgctattcccaagcatatgtcgtgatgccgggcggcttcgggacgctggacgaattgtttgaaatcctgaccttggtgcagacgggcaaagtgccgccgcgtccgattgttttggtcggaaaggcgttttggtcgggcttggcggagtggataaacgcgcagcttttggcgcgcggtctgatttccgaaggggcggtctctttgtttgccatatcggacgatgaagacgaaatcgttgcgtatctgtcggaacacgggcttcagacggcatagcgtcctgagagtgatgtataattgcaaacaatttaacaatttttgatgtctttcccgaacaggatgccgaaatgatcaaccccatcgcctcgctttcccctttagatggccgttatgcccaatccgttgaagcattgcgcccgattttttccgaatacggcctgatgaaggcgcgcgtcaaagtcgaattaaactggctcaaagccctcgccgccgagccgaagattgccgaagtgccgcccttcagtgccgaaacgcttgccgaaatcgacacggtgattgaaaacttttcattggaagacgcggccgccgtcaaagccatcgaagccaccaccaatcacgatgtcaaagccatcgaatattggctgaaaaaacgttttgccgaagtgccggaagtcgccgccgtgagtgagttcatccacttcgcctgcaccagcgaagacatcaacaacctgtcccacgctttaatgctgcaagaagcgcgtgaggctgttttgctgccgaagctggccgaaatcatcgaaaaactgaccgctatggcgcacgaccttgccgccgtcccgatgatgagccgcacccacggccagcccgccacgccgaccactttgggcaaagaaaccgccaatgtcgtgtaccgcctgcaacgccagtttaaaaacctgcaagcgcaagagttcctcggcaaaatcaacggcgcggtcggcaactacaacgcccatatggtcgcctatcctgatgtagattgggaaacccactgccgcaacttcgtcgaaatcagcctcggtctgaccttcaacccctacaccatccaaatcgaaccgcacgactatatggcggaattcttccaaaccctcagccgcatcaacacgattctcatcgactttaaccgcgacgtttggggttatatttcattgggttacttcaaacaaaaagtcaaagcaggcgaagtcggttcttccaccatgccgcacaaagtcaaccccatcgactttgaaaactccgagggcaacctcggtatggcaaacgccgtattgggctttttgtccgaaaaactgccgatttcccgctggcagcgcgacctgaccgacagcaccgtattgcgcaatatgggcgtaggcgtgggctatgccgtattgggtttcgccgcccacctgcgcggtctgaacaagctcgaacccaaccccgccgcgcttgccgccgatttggatgccacttgggagctgctcgccgagccgattcaaaccgtaatgcgccgttacggtgtcgccaatccttacgaaaaactgaaagacctgacgcgcggcaaaggcggcatcacgcccgaagtgctgaaaggctttatcggattgctggaaatccccgccgaagccaaagccaaattgcttgagctgacccccgcgctgtatgtgggcaaggctgaagcgttggcgaaacggatttgagcgtttactgaaaccgatgccgtctgaacgcgcgttcagacggcatttttaagataacgggacatacgggggcgatatttatgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcctttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaaggggggatattgaaacaggaacacctccgcccgttgcccggcgcgccccttgctgcggaaaatcattttccggaaaccgtcctgaccctcggcgactcgcacgccggacacctgagggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcctgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaattccacaaacacgaacgcctgcttaaatcttcccacggcggcgcattgcagtagcctgccttcttgtcggatattgcctttggcagcctatgccgctgtttgccgttcggggcggcggcttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattttgccgttttgaggccggggtcggaataaccgttttttgatgattttccctccccggctgtgtcatcaaaaccccaattgcctttccaaactctccaccagattgtcatccagtttcaaagcctgcgacaggcgggcgaggaagacggtttctttccgcgacaaatcggcacagaccaaccttgccgccagataggcctccgccgccaacgcctcatcgttgccgacggcggcggcgatgtcttcgatgcttgcgggaaggcggtattcggcggcgagccatgcggcagtttcggggtctgtgccgctttcctgttcgatagtccggcgttcggcttcgtctatcatgccgtctgaagcggcggcggctatcatggtgcgcaatacggtacggctgtatgtttcttcagtttctccggcaggttggaaatcgctttgtgttacggttgcccgccctttgttttgctgccacatctgatagccccggtaggcgaggtagcccaaagcggcggtcgaaccgattttggtgatggttttgcggtttttaccgttcagcagcatggaggcgacaccggcaaccagcgcgcctccgccgaatgaattgagcgggctgtcggagaatgtgttgccttttttttgaaccgtgcttaagacttggttgagcagtcgggtaaagttcatgaatttttcctttctgttgcgggaagggcggtatgtttaccctatccttttaaacggcggcaggccggccaataattgttggccgtaccgctgtgttttgatgcggttgtcgaggatggttacgcggccgtagtcttgttcggtgcggatgaggcggccgacggcctggatgagtttgatgccggcttcggggacggtgatttcgatgaaggggttgccgccgcgctgttctatccagcggttttgggttttttcgatggggttgtcgggcatggcgaagggaagtttggcgatgatgacttgcacgcaggcggtgccgggcaggtcgagtccttcggcaaagctgtcgagtccgaagatgatgctggctttgccttcttctatggcccggtggtgtttttgcaggaggacggctttgggtaattcgccttgtacgagcaagagcggcaggtagtctccgggcaggcgcagggcgacatcctgcatttgtttgcgcgaggaaaacaagacgagcgtgccgatggcttcggtgggcgaaataagcttgggcagccattcgatgacggcggcggtgtgggcttcggggtctttggggctggcgtatatgggggggatgtagagttcgccctgtttttcaaagtcaaaggggcttttgagggcgagggtggtggtttcgggcagccattgcagcccggtttggcgcagcatcaggttgaagttgcccaaggattgcagggtggcggaagtcaataccgcgcctgccgcacgccgccacaggctgttggcaaggtgggatgcgctgctgatggggctggcgttgaaaatgtagtcgtttttgtcgtcggcgcggcgggttatccatttcgccaacggttcttcaccctcgagggggacagtggagagcaaatcccaaaccgcgctgatttgttcgatacgggcgataaaaagaccgaactcgctggtcaggcggtcgaggagcgcgccgtcctgttctttttcgcggcgtgcggcagaaagcgcatcgttcagcccgataacgtgtttgagcaggctgcgcgcagcaatggccgtattggaaacggtggtttcgaggccttcggggattttgccgtcttcccacagccaagtcggttcgctgttggttcgtctgtcgttttcagacacccccagacttaaagacggctcttccgccaaatggaattgccattcatgcaggctgtcgagcaaggatgcggcggcttcgtcggctaggttggcaagttcggctttatcggtcagcgcggcaattttgccggtcagctgcggcagtttttccagcgtccaaacggcaatattccatgaatgttcggcggcaaaacggctgagggcttttttgggcaggtggtgcgcttcgtcgatgcaatagaaactgttttcgggcgcaggcagaatcacgccgccgcccatactgatgtcggcaagcagaagatcgtggttggcaacgacgacatcgacggtttccaagacatcgcgtgctaggtaaaacggacattccggacggttgggacaggcggttttcaggcagccgtggcggtcgttggtcactttgagccaaatcgcgtcatcgattttttccggccaagtgtcgcggtcgccgttgaaccgtcgggcggaaaattcgtcggcgatgtcgcgcagcagcttcaattcttcgggcttgggtttgctgtcccacaagacggcgggggcttcaaagccgagcaggttttgctgggcattgctttgcgtcagtcgatagagtttgtaggggcagagatagcggccgcgccctttggcaagtgcgaaggtcagttccaaaccgcttttttcgaccagaaacggcaggtcgcggtctaccaactgctcctgcaaggcaaccgtcgcgctgctcacaatcagccgcttgccgcgtgtttgcgccatgatgccgccggccaaaaggtaggccaacgatttgcccacgccggtcggcccttcgatcacggcaatgctctcgccttcgcgcttgggcggctcgccgccttcttcgcgcgccaacgtccgcgaaaaagcgttggcaaccgccgcaatcatttcccgctgcgaagcacgcggacggaaaccgggcaggtttttgccgatgttttggtaatggtcgcggatggcgtttttttctaaatcggtgagcatggcgttttgtacggcggtagaagtgggcttattttaacattgcacggaagcggtacaatatcgttgtcggaatggggggtgaggtgaatcgtgcggacgtggttggttttttggttgcagcgtttgaaatacccgttgttgctttggattgcggatatgttgctgtaccggttgttgggcggcgcggaaatcgaatgcggccgttgccctgtgccgccgatgacggattggcagcattttttgccggcgatgggaacggtgtcggcttgggtggcggtgatttgggcatacctgatgattgaaagtgaaaaaaacggaagatattgagtcattcggacgcaatgccgtctgaaacggaagttcagacggcatttgttttaggttgccgtaccgcttagggaataccggcgacaggatgggcgggatagccgtgggtatcgaccgaacaggcaaaccgccaaggcgtgtggacggtgtcggcggacaggtgggcaagctcgggaatgtgccgtctgacaaaggtgccgtcggggtcggttttgtgtgcggcggcggcaatgtcggggcaggtgtgccgtgaggcggcaagccgccagttgccttggttgattgctgcatcgaaatcggtcagctgtcgggcaaaccatatctcgccttcgcggcgggggaggtttaaaacgtggcagaaaaaatccgcgctcaagcgtctcagggcggggtggaggctgccggttttgtgcaaacagcgcatcgcggcatcgataatcggaatgccggtccggccctgctgccaaagcgtcaggcgcagggtgtgttcaggattgccgtctgaagggtcgtcatccgtgtgctgcaaggcaagttgaaggaaaaaatcgcggcggatgatgttgtccgcccacgcgttcagacggcgttcgaggctttcccgcgcgagcaggcgcggcgagatgcagccggcactcaaatacgcgcccatcagcgaagtgtgtttgcgcgaggggaaatcctttaaaacggagtaggaatccgcctgttcgagaaaccgccgccactgccgccaagccgccgtttcgccgctgttttgcggcaggaagatgccgtctgaaagcgcggcaggctgcggggcggaaaggttttcggggaagggttggcggtatgccgcgaataggtccggaccggcggggggctgcttggaaaagcggtcgagccatacttcgcggtagcggtcgaaatcggcatatgccgtgccgccgtcgggtatcaggtcggttttgccgaaaacggcgcggtcgttgacgaaggttaacgcgatgccgtgtttgtccaattcgtgccaaagggcgttgtcggcgagtttgtcggcaaaagtatgggattcgtcggcgatgacggtgcggatattgaggcggacggcgagccggacgagctcggcaggagatgccgccgtgtagagcgggatgccgcgccctgcaagcccttgggcgagttcggcggcggattggcggtagaacgcggcgcggcgagggttgtctgtttcggcatcgtcaatccaaatgccgataatgggcaaacttcggcaacggcggcgcataaggcggcgttgtcgcggatgcggaggttttggcggaaccagacgagcgtgtgtgcggcgcacgtgtccgcataaagggggcgggcggtttcagacggcatttcggcagcctttcctgctggcgattttttcgttcagaaaatcgatgaagctgcggactttcgcgcttaagaatgccctgtctgcataaacggcattcagccggtcggtcgggacggcgtatccgggcagcagcctcaccagcgtgccgcagcgcaaatcgtgttccgccgcccaaagcggctgataaccgatgcacgcgcccgccttaatcatttcgcgcatcatcagcgtgttgtcggtacggatgacgggggtcagttcaagccggtattttttgccgtccgatttgcgggtgaggtcgagtttctgctggttggtgtaggtcggcaggacggcgggcagccccgccacttcttccggcgtttccggcacgccgttgcgcctcaggaaatcgggcgaggcgagcagggcaaattcgatttccgccagtgggcgcgcaatcagcgacggggacagggtttgggaaacgcgcaacgccaaatccacgccttcggcaatcaaatcgacgtggcggttgtccaaaatcagttctaatgccacttcgggataacgttcgcggtattccgccagccagttgcatatctggctgccggcaaaccacagcggcatcgttacgcgcagcagcccctgcggtttttccgtccccccggcggctttttgcgcggcatcgtcgagcgtgtcgagcgcgtaactgcattgccggtagtattcttccccggcttcggtcaggctgaggttgcggctgttgcggtgcaggagtttggcttggacggtgttttccaagtggctgacgtgtttgcttgccattgcggtggagatgccgagcgcgtcggcggcgcgggtgaagccgccgctttggacgacttggcggaaaaccttgaggctgaacagggtgtccatattttcttgtgtggaaaagttgtatcaataaaagcagtatatatttgaaaaggggaaacatctatactctaccgcctgaaatgaagacaaatatcaaaggagcttttatgtccgattgctgcaaccgtatccaaccggttttgctttctgttttgcgtatcgtaaccgcctacctgtttttgttgcacggtacgtcgaaaatcttcgccttccccattgaaatgggcagcggttcgcccggcgggctgttgctgcttgccggtattttagaaattgtcggcggcattttgctggtgttgggcctgtttgcgcgccctgccgcgtttgttttgtccggccagatggcggttgcctattttatggcgcacgcttccggaaatgctttgttcccgattgccaacggcggcgagtccgcagtgctgttctgcttcgtattcctctatatcgcggcggcgggcggcggagcatggtcgctggacaggctgtttttcaagcgtaaagcctgaatcggactgcctaaagtgtattttgttgaatgtttttgaggaaaagaaatgacccgtcaatctctgcaacaggctgccgaaagccgccgttccatttattcgttaaataaaaatctgcccgtcggcaaagatgaagttgtccaaatcgtcgaacacgccgttttgcacacaccttcttcgttcaattcccaatctgcccgcgtggtcgtgctgtttggcgaagagcatgataaggtgtggcaatttgtcgaagacgcgctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataatttcgcggtcaaaaaaatgccgtctgaaccctgttcagacggcatttttcagtatcaggcggcgagttttccgcattctgagacctttgtttacaaatatcatgttcaatatagttaaaagaaattattctcatttcctccgtgaggcaatataattcggttgttttgttaaattgagtataaaaatgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggtacgaacgatttgagttccatcctcgaaggcaatgccggcatcgacgctgcctacgatatgcgcggtgaaagcattttcctgcgcggttttcaagccgacgcatccgatatttaccgcgacggcgtgcgcgaaagcggacaagtgcgccgcagtactgccaacatcgagcgcgtggaaatcctgaaaggcccgtcttccgtgctttacggccgcaccaacggcggcggcgtcatcaacatggtcagcaaatacgccaacttcaaacaaagccgcaacatcggagcggtttacggctcatgggcaaaccgcagcctgaatatggacattaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataataccagcaacgttaccggcaacctgtttttccgttataccccgaccgaaaacctctacggcgaaatcggcgtaaccggtacaggcaaacgctacggttacaactcaagaaataaagaagtgactacgcttccaggctttgcccgagttgatgccatgcttggctggaaccataaaaatgttaacgttacctttgccgcagccaatctgctcaatcaaaaatattggcgttcggactctatgccgggtaatccgcgcggctatactgcccgggtaaattaccgtttctgatgaaatcaggcaaaggctgaaataaaactaaacacattttttcactcaaatcgaacacgccttcaataaaatgccataaaatccgcacattaatctgacacacaagagatacctatgaaactgaaaaccttagctttgacttcattgaccctgttggcattggccgcttgtagcaaacaggctgaaaccagtgttccggcagacagcgcccaaagcagctcatctgctccggcagcccctgctgagttgaacgaaggtgtgaactacactgtattgtctacgcctattccgcaacagcaggccggtaaaatcgaagtattggaatttttcggctacttctgcccgcattgcgcccatcttgagccggtcttgagcgagcacatcaaaacgtttaaagacgatacctatatgcgccgggagcatgtcgtgtggggtgatgaaatgaaacctttggcacgtttggcggccgcagtggaaatggccggtgaatcagataaagccaacagccatattttcgatgcgatggttaatcaaaaaatcaatctggccgataccgataccctgaaaaaatggctgtccgagcaaacagcgtttgacggcaaaaaagtattggctgcatttgaggctcctgaaagccaagcgcgtgcggctcaaatggaagagttgaccaataaattccaaatcagcggcacaccgactgtgattgtcggcggcaaataccaagttgaatttaaagactggcagtccggtatgaccacgattgaccagttggtggataaagtacgcgaagagcagaaaaagccgcaataagttgaggattgaatgagtaaaggccatctgaaaataggatttcagacggccttttgtatttaggctttatagaagagatgattgcttaaagccttatggttttaaatcagaatatatagcggattaacaaaaaccagtacggcgttggctcgccttagctcaaagagaacgattctctaaggtgctgaagcaccaagtgaatcggttccgtactatctgtactgtctgcggctcgccgccttgtcctgatttttgttaatccactataaatcagaatataaaacaaaaacgccgtctgaaatttcagacggcgttttctgttaaatcggcttacaaacccgggaacatcccttttatccccctcattcctttcgccatacgcatcagtttgcccaagccgttgccgctgaacatcttcatcatttgttgcatttgttcaaactgtttgagcaatttgttcacttcctgcacggttgtgcccgcacccattgcaatacggcgtttgcggctggctttgagcagggcagggttggcgcgttctttaggggtcatcgagttgatgatggcttctactttgcccatcgctttttcagccgttccttcggggatttgtttcgagatttgacccagttcgcccggcattttcgacatcaggttttccaaaccgcccatattgcgcatttgctggatttgttctttaaagtcgttgaggtcgaagcctttgcctttgtgcagctttttcgccattttagcggcggcttcttcgtctatacctttttgaacgtcttcaatcagggtcaatacgtcgcccatacccaaaatgcggccggcaagacggtcggggtggaaaggttcgaggccgttgattttttcgccgacaccgataaatttaatcggtttgccggttacgtggcgtacggacaatgccgcaccgccgcgcgagtcgccgtccatcttggtcaatacgactccggtcagcggcagggcttcattaaatgcctgagcagtgttcaccgcatcctgacccagcatcgcatcgatgacgaacaaagtttccaccgggttaaccgccgcgtgaagggctttgatttcgttcatcatctcttcatcgattgccaaacggccggcggtatcgaccatcaatacatcgtaaaaatgttttttggcgtaatcgacggcggcagttgcaatttcaaccggtttttggttggtatcggacgggaaaaaatccacgccgacctgttcggccaacagacgcagctgttcaatcgcggcaggacggtaaacgtcggcggataccaccaaaacctttttcttctgatcgtttttcaacaggcgggcgagtttgccgacggtcgtcgtcttgcctgcgccctgcaaacctgccatcaacacgacggcgggcggcgcaaccgacaaatccagcgttttgttttccctgcccatcagttcggtcagggctttgttgaccacgccgataaatgcctgatccggcgtcaggctgcccgctacttcctgaccgagggccttttctttgacgttgttgatgaactctttgacgacaggcagggcgacatccgcctcaagcagggcgaggcggacttcgcgcaaggcctctttaatattgtcttcggtcagtttggcctgcccccggatgtttttgaagacattgctgaagcggccggttaaattgtctaacatactggtccttggtctgaataagaatagcttgccccatcaggggcattctttgttaaaataaaatcaaaataatttgatgcggcttgtgtgccggacagcatatcggcaaatccgtcaaggcttgaccgaaatggggattttacaattccaacgttaaaagttccaatatttcataagcggccgcatacggcgcaacagtatagatagagaaagtccaccatgccgacagttttcatctttttgacggcggtttacgcaggattgggtgcatttgcatggcactgccaacagcaggggtgcggccgggattacccgtggaagacggaattgccggttttgggtgcggcattgaccgtccacggcgcggcactgcttatgccggtcattcaagacaaaatcatcattatgggcttcgggtattccggcagcctgattgtttggatgatgctgtttatttattttgccggcagcttcttttatccgctgcgcggagtgcagttgctgctgtatccttgcgccgcactgatgctgctgtcaggtttggtttttcctggaaaattctcgggatatgaaattaccgaccttccctttatgctgcatatcggaacttcgctgctcgcatacgggctgttcggcatcgcaacattattgtccgttttgaccctgctgctgaatcggagcctgcaccgcaggagcttctccaagctcgcaggattcctgccgtcgctgctcagtttggaaaaactcatgttccaggccatgtgggcaggtttcatcctgctgacctattccgtcgtcagtggaacattttttgccgaagccgtattcggcaaacccatgacctttacccataaaaccgtattcggcatattgtcatggctgatttacggcggactgctgctcaagcacagcatgaccgcatggcgcggcaaaaaagccgccgtgtggaccatcatcggatttgtcagccttatgattgcctatatgggcagcaagttcgtattggaaatcattctgaaaagataagaagagccaacagatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgaacgcatcgatctttaacaaattggaaagccgaaatcaacaaacaaagacaaagcgtttgttttgattttttattctttgcaaaggataaaaatctctcgcaagagaaaagaaaacaaacacagtatttgggtgatgattgtatcgacttaatcctgaaacacaaaaggcaggattaagacacaacaaagcagtaagctttatcaaagtaggaaattcaagtctgatgttctagtcaacggaatgttaggcaaagtcaaagaagttcttgaaatgatagagtcaagtgaataagtgcatcaggtggatgccttggcgatgataggcgacgaaggacgtgtaagcctgcgaaaagcgcgggggagctggcaataaagcaatgatcccgcgatgtccgaatggggaaacccactgcattctgtgcagtatcctaagttgaatacatagacttagagaagcgaacccggagaactgaaccatctaagtacccggaggaaaagaaatcaaccgagattccgcaagtagtggcgagcgaacgcggaggagcctgtacgtaataactgtcgagatagaagaacaagctgggaagcttgaccatagtgggtgacagtcccgtattcgaaatctcaacagcggtactaagcgtacgaaaagtagggcggggcacgtgaaatcctgtctgaatatggggggaccatcctccaaggctaaatactcatcatcgaccgatagtgaaccagtaccgtgagggaaaggcgaaaagaaccccgggaggggagtgaaacagaacctgaaacctgatgcatacaaacagtgggagcgccctagtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagctgtggataggggtgaaaggctaaacaaactcggagatagctggttctccccgaaaactatttaggtagtgcctcgagcaagacactgatgggggtaaagcactgttatggctagggggttattgcaacttaccaacccatggcaaactaagaataccatcaagtggttcctcgggagacagacagcgggtgctaacgtccgttgtcaagagggaaacaacccagaccgccagctaaggtcccaaatgatagattaagtggtaaacgaagtgggaaggcccagacagccaggatgttggcttagaagcagccatcatttaaagaaagcgtaatagctcactggtcgagtcgtcctgcgcggaagatgtaacggggctcaaatctataaccgaagctgcggatgccggtttaccggcatggtaggggagcgttctgtaggctgatgaaggtgcattgtaaagtgtgctggaggtatcagaagtgcgaatgttgacatgagtagcgataaagcgggtgaaaagcccgctcgccgaaagcccaaggtttcctgcgcaacgttcatcggcgtagggtgagtcggcccctaaggcgaggcagaaatgcgtagtcgatgggaaacaggttaatattcctgtacttgattcaaatgcgatgtggggacggagaaggttaggttggcaagctgttggaatagcttgtttaagccggtaggtggaagacttaggcaaatccgggtcttcttaacaccgagaagtgacgacgagtgtctacggacacgaagcaaccgataccacgcttccaggaaaagccactaagcttcagtttgaatcgaaccgtaccgcaaaccgacacaggtgggcaggatgagaattctaaggcgcttgagagaactcaggagaaggaactcggcaaattgataccgtaacttcgggagaaggtatgccctctaaggttaaggacttgctccgtaagccccggagggtcgcagagaataggtggctgcgactgtttattaaaaacacagcactctgctaacacgaaagtggacgtatagggtgtgacgcctgcccggtgctggaaggttaattgaagatgtgagagcatcggatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtggttgtgaagatgcaatctacccgctgctagacggaaagaccccgtgaacctttactgtagctttgcattggactttgaagtcacttgtgtaggataggtgggaggcttagaagcagagacgccagtctctgtggagccgtccttgaaataccaccctggtgtctttgaggttctaacccagacccgtcatccgggtcggggaccgtgcatggtaggcagtttgactggggcggtctcctcccaaagcgtaacggaggagttcgaaggttacctaggtccggtcggaaatcggactgatagtgcaatggcaaaaggtagcttaactgcgagaccgacaagtcgagcaggtgcgaaagcaggacatagtgatccggtggttctgtatggaagggccatcgctcaacggataaaaggtactccggggataacaggctgattccgcccaagagttcatatcgacggcggagtttggcacctcgatgtcggctcatcacatcctggggctgtagtcggtcccaagggtatggctgttcgccatttaaagtggtacgtgagctgggtttaaaacgtcgtgagacagtttggtccctatctgcagtgggcgttggaagtttgacgggggctgctcctagtacgagaggaccggagtggacgaacctctggtgtaccggttgtaacgccagttgcatagccgggtagctaagttcggaagagataagcgctgaaagcatctaagcgcgaaactcgcctgaagatgagacttcccttgcggtttaaccgcactaaagagtcgttcgagaccaggacgttgataggtggggtgtggaagcgcggtaacgcgtgaagctaacccatactaattgctcgtgaggcttgactctatcatttgaagaacttcaagagataaaagcttactgactgattcagtcattaccgaatatattgattaaggctttaccgatttgtaacagtttaagtttggcggccatagcgagttggtcccacgccttcccatcccgaacaggaccgtgaaacgactcagcgccgatgatagtgtggttcttccatgcgaaagtaggtcactgccaaacacccattcagaaaacccccgattattcgggggtttttgctttgcccggaaaaaatgtttgctttgcccggaaaaaatgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaataggggaacctgtaaaggaaagggcatcggccgccgtcggtgcttttttgtttggaagggaaatggctaaaatatgtagcattatgttctgtatcgttgtttaccgcttccgcacctttgtccgccttaaagcaggtagacaccgcaatgaatcgacgcaaagaaaatgccgtctgaacatgcgttcgggcggcgttttgttggggggtatcggagcggaacgtctgaaaaagggtttcaggcggtctttgggcgtgtggtgacagtcgaaaacgtgataaggctacctgaaaagtttgggagattttcaggtagcctttggtattgggcgcaacagacgcaggtacagattagcggtgtgccgtaatcgtacgaatgccgattcaacctaagcagacatcagtatttaggaagtggatgtttgatggagcaaaggttgtacgaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaaaatagtacaatactcaactttgaaggtctaaccatggcatactctgcggacttaagaaacaaagctttaaactaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttagggctaatctagtacagcacctaacaaaaaccagtacggcgttggctcgccttagctcaaagagaacgattctctaaggtgctgaagcaccaagtgaatcggttccgtactatttgtactgtctgcggcttcgtcgccttgtcctgatttttgttaatccactatattttagataatgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatagaacgttgcggctacgcggaagccgtactcgttggatttggagcggcccattttggttttgtcaccgtccaagacaatctcacggggtttgtagattgttttgtgacggtagtatggatcaaactcgagaccgacgctgtcggtcaactgtttgcctacattcagaccgataccgacactccaacctttggcgcttttgctgacatcgcgggaagcacccatctgggtcgtcatcactttggttttgccgcgcaaatctgcatatgcatccgcccaaggggtcagggatcatccgtcccccaaatcttggcggatttcgccatggactttcaaagcaaggttttcatgcttggtaacggtgtttttccttatcgccgatgatggctttgcctttgccgttagactcgggaatatcggctaccgtaacggcggacacggctgcaagtgagagtgcaagcagggttttttcatgtttttcttcctataatgaggataaataaatggaaaaagtgtgggaaatacccgcattcccattaaatcttttttcaagcaatgagttctttttgttttcaacattttccttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctctccttgtgtatgaaattttgccggatgtgaaggcggaatcggcagcgggggtgttctgtaccggattgtcgtggaaatgggaaaacggatgttccgtgcaggtttgtccaaatgaatggcgggtattgtttttatcaatctgtttctttttatttgaaataaaatttctaaaataataaaaatatgaaatttaaaatctataaaaaaagatatatcagttattttgaaataaaatagctttgtagtaatatgttgcacttgtttgtgcaaggtaaacgatgtaacctaagccgcgtataaaaacccatcaggaaagatgcaagatgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttgagatttttgacgcagaatgtcataaaatgtcgtctgaagcgttcagacggcatttttgtggaggaaatatgctcaaaataaccctaattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggcggcaagtttggaggcggcattggcattgtgcgcaggcgcggaagaagccgtcattatgggcggcgcgcagatatacggacaagcgatgccattggcgaccgatttgcggataaccgaagtggatttgtctgtggaaggagatgcatttttccccgcaatagaccggacgcattggaaagaagcagagcggacggaacgccgtgtcagcagcaaaggcacgcgctatgcttttgtgcattatttgagatattgaaatataaactctctataaaatcccccgcaaatgatgggctgaaatagaaaatattgttattcccccgaagatgggaatccgggattttaaagttagggtaatttatccgaaataacaacaatcttccatcgtcattcccgcaaaagcgggaatccggaaacgaaaagctaaagcaatttatcggaaaaaaccgaagtttaaagaaccggattcccgcctgcgcgggaatgacgagattttaggttatggggatttattgggaataatggaacaaagaaagcagaaataaggatatagaggctgtctttggatttgcgatggttgtcggagaatgccgtctgaagccgtttcagacggcatttttccagcttgagaacggatgcctgctcaaataagcattggtaaacataccgtcggcagtgatttcccgtcccagccagtccggacggtcaaaatcggcattctcgtcgggcaactcgatttccgcgacgaccaaaggcgcattatcgccaagaaaaacatcgatttcaaacaggctgccgccccatctgaccggataacgccatttttccattttaaacgggcacatcgtttccatcatcttttccgcatcggcaagcgggatttcgtattcaaactcactgcggctgatttccgaaatatagcctttcagcgtcagccacgcctgttttccggcaatgcggacacggacggtgcgttctttttcaacagacagataaccctgcctcaacagcagcggttcgtcggcgtattgccgccagttgtcgtttccaatcaaaaaacggcgttcgatttctatcggcataagatgctccgtcaaaacggtttgaacacgaccagatacagcgcggcaaccatcagcagcacggggatttcgttgaacacgcggtaccagcggtgtgaaaaagcattgctgtaatcctgaaaacggcgcagcagcacgccgcaatacaactggtaagccaagagcatcaagcccaaacacagtttgacgtgtacccagccgctgccccaccagccggcggcaaacggtatcgccgcgccgaacacgaccgcgccgaagcccaacggcgacataaaacggtacagccgcaccgccatgcccgacagacgcacatactcgggattgccgcgcggcacatcaatcatcgccatattgacgaaaatcctcggcaggtaaaacagccctgcaaaccacgaaatgacaaaaaacaagtgaaacagcttgaaccaagaaaacatcatcgcccacaccctgccgaaaagcggtattgtacaggcaaaccgcttgggaaacgtgataaaatcaggcggataaacaaatcgaataaatccttaccgcaaaacggaggcaaaatgctcaaatccatcgaactcaattcccacatccgcaaccgccttgcagaatatctgaaaggcaggggtatggattttcagacggcaatgcaggaagaaaaaggcaacaaagaaatcgccgccatcgtccacagcggtttgcccactctggtccgcaaactgtattccgaacaaaaaatgcagaagtttttttgggaaaagcgggatttgattgccgactacatcagccgccggatgcagggataggtggctgaaatctgttttcaggcaagtgaaaagacaatatggcagattgaaattacgcttatcgtcattcccgcccgcgcgggaatccgacttgtttggtttcggttatttttcgtttcgtaacttttgagccgtcattcccgcgcaggcggtaatccggcttgttcggtttcggttctttttctcgtttcgggtgatttctaaaccgtcattcccgcgcaggcgggaatctaggtctttaaacttcggttttttccgataaatttttgccgcattaaaattctagattcccgctttcgcgggaatgacggcggagggtttttagttttcccgaaaatgcacatcatccaaaatcccgttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtctttaagcttcggtttttcttgataaattcttgccgcattaaaattctagattcccgctttcgcgggaatgacggcggagggttttttgttttcccgataaatgcacatcatccaaagtcccgttattcccacaaaaacagaaaatcaaaaacagcaacctgaaatcccgtccttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaaatcccgttatttccacaaaacagaaaatcaaaaacagtaacctgaaatcccgtcattcccgcgcaggcgggaatccggcttgttcggtttcggttctttttcttgtttcgggtgatttctaaaccgtcattcccgcgcaggcgggaatccagacctttaaaccccgaccatccttgataaattcttgcggcattaaaattctagattcccgctttcgcgggaatgacggcggagggttttttgcttttcctgatttttcattgcgatgtagtataatgtagtatataatcattataattttaacacttgacaaaggaaaatttctcatgacactgaaagcaagcaagcaagcaagcaagcaagcaagcaagcggtcgggttaatctattaacattatctgttttatcgctgttttgcacgccatatgtttgaggttcggatgcgtacgatcccgtcaaagaagccgagattaaaaacaaatttattttagaagcggcggaagacagaaattcccacgtttggcgcggcccgtgcagcatatcttttgattgcttcggtatgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttgatgcgtcgggaaatgttttgacgcacaggcggtacaccggcacggcaccgcgcgccgccccgcaaaccaatccgaaccctgccgccccgaagggcggggcataatgatgaaaccggcggaaaaccgccggttttttgccgccgtttgaaacccgattctggcttcagacggcattgtcgcggcatcgggcggcagggtttggaacagcggcataaaaaactgatacaatccgccgattgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctgattgctgttccttttcggaggaaaccctgccggcggcggtatcacggcgggcatcggcggctttcgggcggtgctttgcgtgccgccgcgtgtgcggaaacgcattccggtttttccggcataacggcgatgcgaggtaaaatgccgtctgaaacccgattcgggcttcagacggcattgtcgcggttgcggcgggcgggttcaccagattccgtcaaaggttttcgcgccgcgccaaaatttccacctgtcggcgggtttgaaggtcagcgtaccgccgtgttgtccgtccgtggtgatgtccagccgtttgattttgccggtgcggacggcttcgtagattggtgcgaaccagcgttcttcccactgctgcaatattgccgcataccgctccctgtcccctgtcagggcggtcaggcgcaaatcgtccataaacaggatatggtgcgtgtcgggcaggtgtgccgccgtttcttcataggcgcggaagttgtcgggtaatgcgcggcggtcggagtggaaacggctccaaaccgtatcggcgaaaagcgtgccgccttgcgcgccgccgtttgtgccgtcccaaagccataagccgttcaactcgggcagcccgcgtttcttgcggttatggttgacggggtgcgccgccagccacatttggatttcggtttggacgcgcagccattccaacgcatcttctccgtccggctgatcgtcagcgcccaacaatccgcccaagtccaaaacgggcttcgcgccccagcggtacgcgcaaggaagggaaaccagccataattcgggcaggacgggaacgaaacgccatggaatgtcgccgtaaaacgccgacaggtcgcggcagatccgttccgcttcatccgtaccgacgttcagatattccgccgttagcacatttgcctgatgcatccccatcttttgccagacgggcgtggcgagcgcgacggcttcagacggcatattcaggctttgcgccgcgcgttccaccagtctgccgcaccacaaataacgcgcgtaaaatgccgaagccgtgcagctttggcggtgcagcgagccgtattgcaggattttgttgaaagcgtgcaggcatagaggtattcggatttcgtcttcatccaaattgagcgagggaatggcgagggtgagtttcatcgtttgacgtttcagaaatgcaggtcaggcgcaacattatagaggattcggcgcaaacgccgtcaaaaaggaacaatatggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgaaaacctgcaaacaggttttcagacggcatttatagtggattaacaaaaatcagtacggcgttgcctcgccttagctcaaagagaacgattctctaaggtgctgaagcaccaagtgaatcggttccgtactatttgtattgtctgcggcttcgtcgtcttgtcctgatttttgttaatccactatgcagttgattaaaacaaaactaagccaaggaagcactgccgtcattcccgtacgggcgggaatcctgacaccacggcacggaaacccatccgctgtcattcccacgaaagcgggaatctagaaatacaacgcggcaggagtttatcggaaatgactgaaacccaacgtaccggattcccgctttcgcgggaatgacgaagtgggcgggaatccggatttatccgttccgacagtgtttgcaaataaaagaaaacccaaccgtcccgattcccggcagggctgttttacggattttgcagcgagggcgcggggcggtcttgcgcctgtttggtttgcagggttgtcagttttttcgtcagcagattcagtatcacgccgtaggcgggcaggaagaagagggtgcagacggtaagtttgaacaggtaatcgacaaaagcgatgccctgccagtttgccgccataaatccatcgctgcttgcgtagaaggcaacggcgaaaaataccagcgtatccaaggcgttgccgatgacggttgatgcggtcggtgcaatccaccacgctttcagacggcgtaatttgttgaatacaaaaatatcaaggatttgtccgatcgcgtaggcggcaaagctggctaaggcgatgcgtccgacaaaggtgttgaattcggacagcgcgcccaagcctgtccaactgccgttgtggaacaaaacggaaaagacgtaggaaagcaaaagggcggggaacatcacccaaaagataatccgccgtgccaagtgagaaccgaaaatgcggacggtcaggtcggtggcaaggaagatgaagggaaaggaaaatgcgccccaagtggtgtggatgccgaaaatttggaaagggaactgcaccagatagttgctggcggcgatgatgaggatatgaaaaagcaccagccggaagagtgccttctgttgctgtgcggcggtaaatgcgtacataaaaatctttcggaaaggcgttcagacggcatatcgtatcgaaggaatgccgtctgaaatatgggaaggatggtttattgtgcgtcgtgctcaaacaagcgtttgcgtgccaatgtttcgaactcggtgcctgcttttccgtagttggcaaacggatgaatggcgatgccgccgcgcggtgtgaactcgccgaatacttcgatgtatttcggatccatcagggcaatgaggtctttcatgatgatgttgacgcagtcttcatgaaaatcgccgtggttgcggaagctgaagaggtagagtttcagggatttgctttccaccattttgatgtgcggaatgtagcggatgtagatggtggcgaagtcgggctgcccggtcatggggcagaggctggtgaactcgggacagacgaatttgacgaaatagtcgttgtcgggatgtttgttgtcgaatgcttcgagaatttcaggcgcgtagccggtcggatattgggttttttgattgcccaaaagagagatgccttgcagctcttcgttgttgcgggacatgagggtttccttagttttttaatgtgggaggttttcgaaccacgggcggcgattgtaatataagcggcggtatctgtgtagttttcttcagacggcatggtttggacggcggcgttttccgtgtcatatatagtggattaacaaaaaccagtacggcgttgcctcgccttagctcaaagagaacgattctctaaggtgctgaagcaccaagtgaatcggttccgtactatttgtactgtctgcggcttcgccgccttgtcctgatttttgttaatccattatataaacgaaatatattttcagttttgccgcctgaagcgttgttttttgaatattgcatctaaaatactgacttgattgcgttattgcgcggatatagaatctgcttcctattgaaagaacattgtttatatgaaatcaggaaattcggaacccaatcttatggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctgatgccgtctgaaacggaggacacaatggattatccaccgcttaagggtgcggcattggcgtgggttacgctgtctttggggcttgccgtatttatggaagttttagatacgactatcgccaatgtcgccgttcccgtcatcgccggcaacctcggtgcggcaaccactcaggggacgtgggtcatcacttccttttctgtggcaaacgccgtttccgtgccgctgacgggctttttggcaaaacgcatcggcgaggtcaaattgtttaccgccgccgctgtcggtttcgtcatcacatcgtggctgtgcggtattgcccccaaccttcagtcgctggttgttttccgcatcttgcagggctttatcgccgggccgctgattcccttgtcgcaaagcctgttaatggcatcctatccgcccgcaaaacggacgctggcactggcattgtgggcaatgaccgtcgttgtcgcccctgttctcgggccgatactcggcggctggatttccggaaactggcattggggttggattttcttcattaatatccctatcggtatcatatcggcatggattacatggaaacatttgaaatatcgggaaacggaaaccgttaaaatgccgaccgactatgtcgggcttacattgatggtagtcggtatcggcgcgttacagatgatgctggacaggggtaaggaactcgactggttcgcctctggagaaatcattaccttgggcgtagtcgcactggtgtgcttgtcgtattttattgtttgggaattgggagaaaaatatccgattgtcgatttatcgctgtttaaagatcggaattttaccgtcggcgtcattgccacgtcattgggttttatggtgtatatggggacgctgaccctgctgccgttagtgttgcagaccaacctgggctatacctccacgtgggcagggcttgccgccgcacctgtcggcatcctgcctgttttcctgtctccgttaatcggcaggttcggcaataaaatcgatatgcgcctgttcgtaactgccagcttcctgacctttgcctttactttctattggcgtacggatttttatgccgatatggatattggcaacgtcatctggccgcagttttggcagggtgtcggtgtcgccatgttttttctgccgctgaccaccatcacactgtcgcatatgaagggcgggcagattgccgccgcaggcagcctgtcgaatttcttgcgcgtgctgatgggcggtgtcggcgtatccgtcgtcagcaccctgtgggaacggcgcgaagcgttgcaccacacacgctttgccgaacacatcacgccctattccgcaacattgcacgaaacggccgctcatttgtcccagcacggcgtttccgacattcaaaccctaggcatcatcaacaataccattacccagcagggttttattatcggctcgaacgaaatctttatggcgggcagcttgttattcattatcatgatacccgtcatatggctggcaaaaccgccgttccacaacggcggcggcggtggacattgagggatttgaaaacttgaaatgccgtctgaaaatactggaaatatgttcggacggcattttgaatgcagcagttcccgaaatccgctataatcgcgccccatctgtttcgcacctgcaaacgttccacagatgcgacaatcggaaggattatccgcgcaaaacagccgtttttctttaaaacacttgaactaacactgtttttcgtggtataaatcgcgttttactattttagaagtttggagactgattatggcacgagtttgcaaagtgaccggcaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcactgcgtaccatcgacaaagtaggcattgatgtcgtattggctgatttgcgtgctcgcggcgaagcttaatttaaacactatttaattaaggattactgcaatgcgcgataaaatcaaactggaatccagtgcaggtactggtcacttctacaccactaccaaaaacaaacgcactatgcccggcaaattggaaatcaaaaaatttgacccagttgcccgcaaacacgtagtgtataaagaaactaaactgaaataatttcagtttgaaagcaaagcctccgactgctcggaggctttgttatttttatcgtgtttcctttccgcttgaaacatctgccgtatgcgaatctgctgcaaaccgtctgccaaggatatgaaaaccgcaaaacggttcataacacaaaaatgccgtctgaaacgtttcagacggcatttcggcagttttcaaccggtcagttgtttggtgatcagtttcttcagcggtgggaaattgttgctggcacgcaataccaagccgcgcaacagttttgccggtgcggtctcattggtaaacagtttcagcatcatattggttccgtgataaagcggatgggcgtgcagcatatgtttgctgctgtatttttccaataatgaagatgcaccgatgtcttgaccgcgctgttcggcttcgagtatcagttttgccaaaatatctgcgctggaaagccccaagttgaaaccgtgtgctgtaacggggtgcataccgacggcggcatcgccaatcagcgcgctgcgtttgccgtagaaacgtttggcaatcatgccgacaagggggtaatggtggatgctgctgaccaattccatatcgccgagcctgcccttgagctgttcttttacgcttgccgccaattcttcgggcgaaaggttttgaacgctgttgattttatcggtatcgacggtaatgacggtattggtcaggtgctcttccagcggcagcagtgcgatggtgcgtccgtaatggaagcattcgtaagcggtatgttggttggaaagggtatgtttcatacggcagacgaacatggttcggctgtaatcgtgcatatcggaggagataccgagttgtcgacgggtttgcgagaagcggctgtctgccgccaaaagcaggcgtgcagtcagtattttgccgttttccaaaatgacttgtgcttcgttgtcagatgttttgacttctttgacaaccgtatcggtcagaatgctgacattgtcgagttgtgatacgacttcataggcggcgcggcggatattgtggttggaaatcagatagcccaaacagtcggcaggttcgccgcgcgcttcagtcggttggggaaagtggagctggtagtcggaacgtccgttcagcactttggcatcgcgcaaagggtagatttcgttttcgggaattttgtcccacatacccaaacgctgcatgatttcgcgggaaaaatgggtcagggcgatttcgcgtccgtcatatggaggattttgcagaacagtcagtgggctgcgttcgatcagggtaactttcaaaccgctgccggcaagttcggctgcaaaacttaaacccgccgggcctgcgccgacgacgaggatgtcgctgtgtaaactcataaaatatcctttgcatagacggatgccgatgatttcagacggtatttgtaagggtttgaatgccgtttgaactatctgtaacagataggcgattatatcaaaacccactgttgaagaaatatgcaggggagggtgtatgcggatttttactttcagcttaatgtgtatcaaatcgggtgtggggtatgtatagtggattaaatttaaaccagtacggcgttgcctcgccttgccgtactatttgtactgtctgcggcttcgtcgccttgtcctgatttttgttaatccactataaaaagccgcatcgtgaaaagatgcggcttcaggtatcggttggattattcttcagaaccggtgtaaggacggatgctgacagttttacggttcagcgcgcctttggttttgaattcgacataaccgtcaactttggcgaacaaagtgtggtctttgcccatacctacgttgtcgcctgcgtggaatttggtaccgcgttggcgtacgatgatggaacctgcgggaatcagctcgttgccgtaggctttaacgcccaagcgtttggcttctgaatcgcgaccgttgcgggtgctgccgcctgcttttttacttgccatttgtaatgctcctaagttttaaggttaggcgattgccacgatttcgatttgggtgaaattttggcggtggccttggcgtttttggtagtgtttgcggcggcgcattttgaagatgcggactttttcgccacgaccgtgtgccactactttagccgttacttttgcaccttcgataaagggtgcgccaacttttacagattcgccgtcagcaatcatcaaaacttcggtcagttcgatttggctgtcgagttcggctggtatctgttctactttcaatttttcgccgacggaaactttatactgtttgccgccggtttttacgaccgcgtacatactcaactccataagggttatggttaatatccgcacaccattgtgcggaactcggcattgtattgttatttgcctgttttgtcaaagtttgcgcggttcggataaccatatgccgtctgaaaagatgtaccctgatggctttgctgatataattgcccgctatttgaatcagctttcaagcggtatctgccgtttgacggaaacgtaaacctgagagtctgccatgctcgagaatctgccctatttccagcgacatctgcctgaagaccttgccaaagtcaatgaagtcatcaaccgtgcggtgcaatccgatgtcgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaagaacaatatatccaagtcatccaatataaaacggcaaaattgtttgaagctgccgctcaagtcggcgcaattttgggcaaggcttcccccgaacacgaacgggcgttgaaagactacggtatgtatgtcggtacggcattccaaattattgacgatgtgctggactattctggcgaaaccgaagaaaccggcaaaaacgtcggcgacgatttggcggaaggaaaaccgactttgcctttgatttatctgatgcgtcagggttccgaacaggttgcgaacgatgtgcgtactgctttggaaaatgcagatcgcagctattttgagaaaatccacgattatgtcgtccgttcggatgcgttggcatattcgataggcgaggcgcgcaaagcagtcgattgtgccgttaccgccttggatgccctgcccgacagcgaagtgaaggatgccatgattcagctggcgaaggaatctttggtcagggtgtcttgaggcgatgaatttcagttttgttcccctgtttctggttacgctgattctgttgggggtggtcagcaacaacaattcgattaccatctcggcaaccatattgctgctgatgcagcagacggcattgatacagtttgtcccgttggtcgagaagcacgggttgaatctcggtatcattcttttgaccataggggttttgagtccgttggtttcaggaaaggcgcaggttcctcccgttgccgaatttttgaattttaaaatgatatccgccgtttttatcggtattttcgtggcttggctggcgggacgcggcgtgccttatgatgggacagcagcctgttttaattacagggctgttaatcgggacggttatcggggtggcatttatgggcggtatccctgtcgggccgctgattgcggccggcatcttgtcttttgtcgtcggaaagggttaaaatctccttttcatttcggctcgccatagttcaacggatagaacgtatgcctcctaagcgtaaaatacaggttcgattcctgttggcgaggtttgacgatttcatttgtctgtttcccgtgttgcgggaagtttccgatataaggcctttcagtgttggagggcttttttgccatctgaaaactttttcttcctgcttgaaaaaccgacctttaggacggtagaatcatgaaatgattttcaggcttcgtaaaagatgttccggcttggaaatctgttgttttatgatatagtggattaaatttaaatcaggacaaggcgacgaagccgcagacagtacagatagtacggcaaggcgaggcaacgccgtactggtttaaatttaatccactataaaagctgtacaggtataacaatgaataaatttggggataaggtcgtatgagcgtaggtttgctgaggattctggttcaaaaccaggtggttactgttgagcaggccgagcattactacaatgagtcgcaggcgggtaaggaagtgttgccgatgctgttttcagacggtgtcatttcgcccaagtcgcttgcggcattgattgcgagggtgttcagttattcgattcttgatttgcgtcattatccgcgccacagggtgctgatgggggtgttgacggaggagcagatggtggagttccactgtgtgccggttttccgtcggggcgacaaagtattttttgcggtttccgatccgacacagatgccgcaaattcagaaaaccgtttctgccgcagggattgaggttgagttggtcattgtcgaggatgaccagttggcgggtttgctcgattgggtgggttcgcgttcgacatcgctgcttcaggagcttggggaggggcaggaggaagaggaaagccacaccctgtatatcgacaacgaggaggcagaagacggccctgttccgaggtttatccataagactttgtcggatgccttgcgcagcggggcatcggacatccatttcgagttttacgaacacaatgcccgtatccgtttccgtgtggacgggcagctccgcgaggtggttcagccgcccattgcggtaagggggcagcttgcttcacggattaaggtaatgtcgcgtttggacatttccgaaaaacggataccgcaggacggcaggatgcagctgacctttcaaaagggcggcaagcctgtcgatttccgtgtcagcacattgccgacgctgtttggcgaaaaggtcgtgatgcggattttgaattccgatgccgcgtctttgaacatcgaccagctcggttttgagccgtttcagaaaaaattgttgttggaagcgattcaccgtccctacgggatggtgctggtaaccggtccgacgggttcgggtaagacggtgtcgctctatacctgtttgaatattttgaatacggagtcggtaaatattgcaacggcggaagaccctgccgagattaacctgccgggcatcaatcaggttaacgtcaatgataagcagggcctgacttttgccgctgctttgaagtctttcctgcgtcaggacccggacatcattatggtcggtgagattcgtgatttggaaactgccgatattgcgattaaggcggcacaaacagggcatatggtgttttccaccctgcacaccaataatgcgccggcgacgttgtcgcgtatgctgaatatgggtgtcgcgccgtttaatattgccagttcggtcagcctgattatggcgcagcgtcttttacgcaggctgtgttcgagctgcaaacaggaagtggaacgcccgtctgcctctgctttgaaggaagtcggcttcaccgatgaggaccttgcaaaagattggaaactttaccgcgccgtcggttgcgaccgttgccgggggcagggttataaggggcgtgcgggcgtgtatgaggttatgcccatcagcgaagaaatgcagcgtgtgattatgaacaacggtacggaagtggatattttggacgttgcctataaggagggtatggtggatttgcgccgggccggtattttgaaagttatgcagggcattacttcattggaagaggtaacggcaaataccaacgattaggtttgagaatgaaaatgccgtctgaagcgtgtttgtttcagacggcatttgactttcagggtgtttgccgggaaggcggggcggtcagcggtatgccatgtcgggttcggatatttccggcaaactttccgtttggccggaaaccgtatatttcccgtctgcccatccgcccaagtcgatcagtttgcagcgttgcgaacagaaggggcggaatgcgttttcgggtttccatactactgctgtttgacaggtcggacatttgacttgaaggcgtgtttgccgcgattcagtcattgtgttttccttgtgttggttttgaggcgaaaatccctgaataaaacgcgtgcaggcgcattgttttctcacgcaggcttttgaggctgccgtcattgagcagcacatcgtctgcaagcagcaggcgttcggattcggatgcctgatggctgatgacggccgccacctcgccgcgcgtcagcccgctgcgggccatcaccctgccgatacgtttttccacaggggcacttatggtcaggacacgccgtatcaggctgataaattgacgcttttccgtcagcagcggaatttcgacaatgccgtaagctgcatcagtaaaggtttcttgctgttttttgatttctgagaaaatcagcggcaacatcacggattcgagcaaggcttttcgcgatggggaggcaaagacttctttacgcaatatgtcgcgccgcaacaaaccctgtgtgtcaaaaacggtgtcgccgaacagccgcctgatttccggcagggcgatgccgtctgaagccgtcagcgagtgcgccgccgcgtctgcatcgatgcgcggcacgcccaaatcggcaaaacattgcgcggctgccgatttgccgctgccgattccgccggtcagtccgacccataccgtcatcttacagcaccggatgggtcagccaccagttgaccgcccgccatacggaatcgtttgccgtaaaaattatccagcccgaaactgtcagtgcggggccgaaggcaaaatgctgccccttggcgacgcgcataacgattgccgcgaccaaaccgatcagcgaggaaacaaaaatcagtacgggcaatgcggatatgccgagccacgcgcccaatgcggcaatcagtttgaaatctccgttgcccataccggtttttcctgtgagcagtttatacactgcacataagagccataatgaaccatagccggcgaccgcacctaaaacggcagactgcaaaggcacgaagccgccgtccaaattaaatatcagacccagccaaattaagggcagtgtcatcgagtcgggcaggtattgggtgtccgcatcgataaaggtcagggaaatcagaaacgcggtcagtaccaatccgcccagcgtaatccaagaccagccgtattgccaggcgaccagcccgaacaatacgccggtcagcagctcgattaagggataacgtatgctgattttggtttggcaggaagcgcatttgccgcgcaggagcaggtagctgacaatcgggatgttctgccacgcgcgtatcggcacgcggcatttgggacagcaggaatccggtttcatcaggttgaaggtacggctttcctcttcggtcagcggcaggtttaaatattctttggcaaataccgtccagccgcgttccatcatgaccggcacgcggtaaatgacgacatttaagaaacttccgaccagcagcccgaacaccgctgccaaaggcacggcaaacggcgacaatacagacaaatcagacatattttgttctcaatgtattcaaaacaaaaacaaaccggcgcagagcgaatccgcgccggatctgtgcggcaaatcaggcgaccacgttgcccaaattaaacagcggcagatacatggcgaccagaagcgtgccgatgaccaagcctaaaatcacgataatgatcggctccatcatagcggacagcctgccgaccgcattgtccacctcgtcttcgtaaaattcggcggctttgttgagcatatcgtccaaagaacccgattcctcgccgatggaagacatctgcaacatcatattggggaacagttccgtcgcacgcatccccgaagtcatagacaaaccttggatgacgcgcgtacggatttcccgggtggcttcttcatagattaaattgcccgccgcgccggcagtggagtccaatacatcgaccaaaggcacgcctgccgcaatcagcgtcgccgtcgtcctgccccagcgggcaatcgttcctttgcggacaatgtctccgaaaatcggcatacgcagcagtatggcatccatacgccgttggattttaatcgaacgcgccttcaatttaaggaagccgtatatggcaaagcccagtgcgatcagcaccatccagccgtatgagacgaaaaagtcggacatatccatcactgtttgggtcagtgcgggaagctccgcgcccatattggcgtaaacttctttaaaggcgggcagtacgaaaatcatcatcacgaataccaaaccgatggcgacggcgatgacggataccggataggtcagtgcggtttttacctttttgcggatggcctgggttttttctttgtaaattgccaatttgtccagcaggctttccaatacgccgcccgtttcgcccgccgcaaccagattgcagtagaagcggtcgaaatattttgggtggtttgagaatgcgcggctcaacgagctgccctgttccacttcgcctcggatttccatcagcatttccgtcatagacgggttgccgtgtccgcgcgccacgatttcaaatgcctgcatcagcggcaggcccgctttaatcatcgtggacagctggcgggtgaaaacggtgatgtcttcttgtgtgattttgcgcttggagcttgttttcacacgggtaatctgcaacgggcggatgccgcgttttgccagttttttgcgcgcctcttcttcggtaaacgcggatacttcgccgttgaccagtttgtcggaggcggaatgcctgccttcaaagataaagcgtttttctttctttgcgaacaaagaaaatcctccgtttttagccatattctagccccgtaaagtaattggaataaaatgtaagaaacatcgttaaaaaacagtaccggcgtgttcccggtaagatgaaaaccgccgacatcccgcctgcgggcggcaaacgggacagaatcggatgcgattataccttatttaggcggctgtccggcatttatgcgtacacaataaatcttgcaggatattgttgcgggtcaaatgccggccggagggcatttccgccatatggaaataaggtgctattggacgcggcgggcggtgttccggagattcgccaaagccgctgccgtttgttaaactacattctgctacattttaatccggttctgaaaaatcaaggaaaacagatgaatgcttttacccgtgcatggtatgcgctcgaacgccattatcaggatacgcgtcatgtccttttgcgcgaccgctttgcctgcgaaccggaccggtttgagcgtatgcacgagcgtttggacgggatgttgttcgattacagcaaaaaccgtttgggcgaagatacgctgcaactgctctgcaatcttgccgacgcggcggatttggaagggaaaatgcgtgctttgcggacgggtgcgaaagtcaacggcagcgaggggcgtgccgcgctgcatacggctttgcgcctgcccgacggtgcggatgccgtttatgtggacggcagggacgtgttgcccgaaatccgccgcgagttaaatcgtgcgttgaagtttgcacacagtttggacgacggttcgtatcaggggataaccggaaaacggattacggattttgtccacatcggcataggcggatccgacctcgggccggcaatgtgcgtgcaggcacttgagccgttcagacggcatatcaccgtccattttgccgccaacgccgatcctgcctgcctggatgcggttttatgccgtctgaaccccgaaacgacagtgttttgcgttgccagcaagtccttcaaaacaccggaaaccctgctcaatgcacaggcagtcaaggcgtggtatcgcggtgcagggttctcggaatccgaaacggcgtgccatttttgcgcggtgtctgccgacactgcggcagctgcggcttttggtatcgcggcggaacgcgtgtttgcgatgtacgactgggtgggcggacgctattccgtctggtcgcccgtcggtttgcccgtgatggttgcggtcggcggggcgcgtttccgcgagttgttggcgggggcgcacgcgatggacaggcattttttcagtacgccgacgcgtcataatatccccgttttaatggcactgattgccgtgtggtacaacaatttccagcacgcggacgggcagaccgccgttccgtacagccacaacctgcgcctgctgccggcgtggctgaaccagctcgatatggagagtttgggcaaaagccgcgcttcagacggcagtcccgccgtgtgcaaaacgggcggcatcgtgttcggtggtgaaggggtcaactgccagcacgcctatttccaactgctccaccaaggcacgcgcctgattccctgcgattttatcgtcccgatgacggcgcagggcagagaggacggacgcagccgttttaccgttgccaacgcctttgcccaagcggaagccttgatgaagggcaaaaccttggacgaagcacgcgccgaactggcagatttgcccgaagcggaacgcgaacgcctcgcgccgcacaaagagttccccggcaaccgccccagcaacagcattttgattgaccgcctcacgccctacaatttgggtatgctgatggcggcttacgaacacaaaaccttcgtccaaggcgcgatatggaacgtcaaccccttcgatcagtggggggtggaatacggcaaacagttggcaaaaaccatcatcggcgaactggaaggcggcacgtccgtacacgatgcctcgaccgaagggctgatggcgttttaccgcgaatgccgtctgaaaggcggcggcgcggcataaaagtactgccgcctttctgtattgattcgggcgcggaaaaggcaatacctgccgcctgcccgattccgaaacgccaatgtttggcaaccgctcgcgtattgctgacgaatatgcgtttgcgtggcacaatagcgcattcatttcaaatgaacatactgcttgaaaataccggcaagcgtcccacgaaacatctcacataaggaaatattatgtctttgcaaaacattatcgaaaccgcctttgaaaaccgcgcggacatcaccccgaccaccgttactcccgaagtcaaagaagccgtgttggaaaccatccgccaactcgattccggcaaactgcgcgttgccgaacgtttgggcgtgggtgagtggaaagtcaacgaatgggcgaaaaaagccgtgttgctgtccttccgcatccaagacaacgaagtcctcaacgacggcgtgaacaaatacttcgacaaagtgccgaccaagtttgccgactggtctgaagacgagttcaaaaacgcaggcttccgcgcagttccgggtgcggttgcccgacgcggcagctttgtggcgaaaaatgtcgtgctgatgccatcttatgtcaacatcggcgcatacgtcgacgaaggcgcgatggtcgatacttgggcaaccgtcggctcttgcgcgcaaatcggtaaaaacgtgcacttgagcgggggcgtcggcatcggtggtgtactcgaacccctgcaggccgcacccaccatcattgaagacaactgcttcatcggtgcgcgttctgaaatcgttgagggcgtgattgtcgaagaaggcagcgtgatttctatgggcgtgttcatcggtcaatccaccaaaatctttgaccgtacaaccggcgaaatctatcaaggccgcgtaccggcaggttcggttgtcgtatccggcagtatgccttccaaagacggcagccacagcctttactgcgccgtcatcgtcaaacgcgtggacgcgcaaacccgtgcgaaaaccagcgtcaacgaattgttgcgcggcatctgatgccttaaaccgtatttgaaacgtccaatgccgtctgaaatccgcttcagacggcattgccgtttgcacgctgcaacgtgaaaacacagaaacagggacaatttgctataatcaacggtttagaacgaaccgaacactatttgaaggatacaaaatgggttttctgcaaggcaaaaaaattctgattaccggcatgatttccgagcgttccatcgcttacggcatcgccaaagcctgccgcgaacaaggcgcggaactggcgtttacctacgttgtggacaaactggaagagcgcgtccgcaaaatggcggcggaattggattccgaacttgtattccgctgcgatgtcgccagcgacgacgaaatcaaccaagtgttcgccgacttgggcaaacattgggacggcttggacggtttggtgcattccatcggttttgcgccgaaagaagccttgagcggcgacttcctcgacagcatcagccgcgaagcgttcaacaccgcacacgaaatttccgcatacagcctgcccgcgttggcaaaagccgcccgtccgatgatgcgcggcagaaattccgccatcgtcgccctgagctacttgggcgcggtgcgcgcgattccgaattacaacgtgatgggtatggcaaaagccagccttgaggcaggcatccgctttaccgctgcctgtctgggtaaagagggcatccgctgcaacggtatttccgccggcccgattaaaacgcttgccgcctccggcatcgccgatttcggcaaactcttgggacacgtcgccgcccacaacccgctccgccgcaacgttaccattgaagaagtcggcaataccgccgccttcctgctgtccgacctgtcgtccggcattaccggcgaaatcacttacgttgacggcggttacagcattaatgccttgagcaccgagggataatccgccgttttcaaatccgtgcgccgtccgtgccgcatatcggtttcgggcggcgttttgccgtctgaagcgtatttctagggaaatgcccgacttacggcaggcgggatgggaaatgcggacgcttgttttaaccgattgcctttgtgccgacttgctgcaggtgcagcggaaacggttcggatgcgaaaatgccgtctgaaacgccaaacgggtttcagacggcattttttatttaaagcatcagcacacttcaaccagccagccgtatttgtcttccgccaaaccatactggatgtcggtaatcgccttacggatggcatagccgcgttcttggcttttcacttcgatttctttgccgccgatgacgaaggaagtaacgggcgagatgacggctgccgtaccggtcaaaatggcttccgcaccgttttccaccgcagctttgagttcgtcaaccgtgaaattgcgttcgctgacggtatagcccaaatctttggcaaccgtcagtacggaatcgcgggttacgccgtgcaaaaactcgtcggtcagcggtttggtaatgatttcatcgccgttaatcaggataaagttggacgcgccggtttcctgcacgtcgccgttcgggcagaacaggacttgatttgcgccatattcggctttcgccttcagcacccagtgcatggcggaagcgtagttgccgccgcatttgacgcggcccatatgcggggcgcagcggatgtgttcggtttccaccaaaattttgacgggcgatccgactttgaaatagtcgccgacgggggaagccaaaatatacagcagggcggtttcggaaggagaaccggccttgccgataacgggatcggtaccgattaaggtcggacgcaggtacagggcggcaggcgcatcgggaatttcatcggcggcacgtttgaccaatttgattagcgcgtcaagataagcttcggtttcggggcgcggcaggtgcaaaatgtccgcactttgccgcatacgcgcgatattggcagtcggacggaacagcacgattttgccgtctgcctgacggaaggctttcagtccctcgaaacattcgctgccgtagtgcagggcgtgcgcgcccggtgcgagggagaggtcttgggaagattgccattcggtcggctgccatttgccttcgcggtaggcgaggacgggcatttgactgtgaaaaacgctgccgaatacggcgggtacgggtctgctcatgatgtaaagcctttcttattctgatatgtttcaatgaacggtttgaatttgaagattgtaaagatacgcctgcaaacagggttttgacaagtgcgcggcgggtttttctgtcgatgcggtgtccaatccgttatttttcaaatggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtctgggcggcgtttttatttacggagcaaacatgaaacttatctataccgtcatcaaaatcattatcctgctgctcttcctgctgcttgccgtcattaatacggatgccgttaccttttcctacctgccggggcaaaaattcgatttgccgctgattgtcgtattgttcggcgcatttgtagtcggtattatttttggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctaccaaacagccttaagaaagccgatatggacaacgaattgtggattatcctgctgccgattatccttttgcccgtcttcttcgcgatgggctggtttgccgcccgcgtggatatgaaaaccgtattgaagcaggcaaaaagcatcccttcgggattttataaaagcttggacgctttggtcgaccgcaacagcgggcgcgcggcaagggagttggcggaagtcgtcgacggccggccgcaatcgtatgatttgaacctcaccctcggcaaactttaccgccagcgtggcgaaaacgacaaagccatcaacatacaccggacaatgctcgattctcccgatacggtcggcgaaaagcgcgcgcgcgtcctgtttgaattggcgcaaaactaccaaagtgcggggttggtcgatcgtgccgaacagatttttttggggctgcaagacggtaaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgtcgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgaccttaacggcgtgtaccgcctgctcggtttgaaactcagcgatatgaatccggcttggaaagccgatgccgacatgatgcgttcggttatcggacggcagctacagcgcagcgtgatgtaccgttgccgcaactgccacttcaaatcccaagtctttttctggcactgccccgcctgcaacaaatggcagacgtttaccccgaataaaatcgaagtttaaccaccaccgaaaggaacacaaaaaatgcgcttactccatactatgctccgcgtgggcaatctcgaaaatccctcgatttctaccaaaacgttttgggtatgaaactgctccgccgaaaagattatcccgaaggcagatttacccttgccttcgtcggttacggcgatgaaaccgacagcacggttttggaactgacgcacaactgggatacggaacgatacgacttgggcaacgcctacggacacatcgcggttgaagtggacgatgcctacgaagcctgcgaacgtgtgaagcggcagggcggaaacgtcgtccgcgaagccggcccgatgaaacacggcacaaccgtgatagccttcgtcgaagaccccgacggatacaaaatcgagttcattcaaaagaaaagcggcgacgattcggttgcctatcaaactgcctgataccgccgccgccaatgccgtctgaagcctttaggggtttcagacggcattttgttgccgtcgacctgctgtttgagcctgtgccggttcaaactttatccgttacaccgataaggcaaaaaagatgccgtctgaaacggcatccttgatctgcgaaagggcagttgggaatcaaatacccaattcctgcgccaatgcttgggcacgtttgagtacgtcgccttccgcttcttccagcaatttctgcactgtctcggcagcggcatcgcggtcgccgatttcgagatacatttcggcaaggtcgtatttcgcttcggaaggcgcgtcagaacctacagattccgaagggaaactggtatctgcattatttgggatattttcttccgagaggtagatgctccaatctaccgtttcctcctcgccgtctttcaggaagtcgggcaaagcgtctgcctcagaggtgttggaatcaggcgtttccaaagtgatttccgctgcattttcctcaacggccggtgcttcagcaggttgcaacagtgcggacaaatcatcggcaacggtttccgctgcattttcctcaacggcaggtgcttcagaaggttgaagtaatgcggacaaatcgtctgcggtggcgttgaaatcgggtgtttcggcaacggtttccgttacattttcctcaacggccggtgcttcagcaggttgcaacagtgcggacaaatcatcggcaacggtttccgctgcattttcctcaacggcaggtactttagaaggttgaagtaatgcggacaaatcgtctgcggtggcgttgaagtcgggtgtttcggcaacggtttccgttatattttcctcaacggacggtgcttcggcaggttgaagcaatgcggacaaatcgtctgcggcggcgttgaaatcgggcgtttcaggcgcagtttccgcgacggcatcggtttcgtacactttcaggaaatcgtgcaactcttccggtgtttggacttcggcaactgttttttccaagatggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgataactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgattaatgccgcgcctccgccggcaagcagcaaggtgtacgaaccgccgaacagaccgtcaaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtgaagcacgctgcccgcacgcagtctgccgtgtgcggaaacatttgggtttgccttcagcagcgcatcggcaacctgttcgagcgtcaggtgtttcgggcggatggcggcggcaatctgtttgaccgtttcgcctttgcggacggtatgggttttgccgttgtatgccggtttgacggctgcgttcgcgctgtcttttttatcggttttgcggagggctttggcgttttgattttcttgggactctgctgtcggagcggttttgcggtgtgtcttgccgtctgaaagtgcagatttggttttgggcgagtagccgacaggatcgaggatggcggtgtattcgcgtacctgtgcgcctgcgccgatgcggaacaccaggacgggatcgcggactgcctgttcggaagaaacggcaatgacggctttgtcgcccaacttgtggactttggcggtcaggcctttttcggaaacggtaacgctgccgccgcctagcagggctttggcttcttcgccggttacggtaatgctgccggaaaagggttcgtcaaggttggactggatattcagtccgcccagtccagcatgtgcctgaaaggatgcggcaactgcgacggaggcggcaatcagtttgatttgtctgttgtttttcaagatgtatcccctgtgggttggcggctgaatacggtttgaccgcgtacagtctgtaaatttcgtcatcatcgggcatcggcggggcagtcggccggcgggcatttaatatgtgaatgtaccgaccgccgccacattttaaacggcaatcattcgccgtttttacaaattatgacatatctccatcttttttcaaaaacatctgtgcatatttgcatcaatcaaaacaaaatttgttggttttgcaggtgcaaaaacagggttctgcctgtatgattagcgtttatttgatttgctttctcatttggatatgaaattcgtcagcgaccttttgtccgtcatcctgtttttcgccacctataccgttaccaaaaacatgattgccgcaacggcggtcgcattggttgccggtgtggttcaggcggcttttctgtattggaaatataaaaagctggatacgatgcagtgggtcggattggtgctgattgtggtattcggcggcgcaaccattgttttgggcgacagccgcttcattatgtggaagccgagcgttttgttttggctgggcgcgctgttcctgtggggcagccacctcgccggtaaaaacggcttgaaggcgagtatcggcagggagattcagcttccggatgccgtatgggcgaaattgacgtatatgtgggtcggtttcctgatttttatgggtatcgccaactggtttgtgtttacccggttcgagtcgcaatgggtcaactataaaatgttcggctcgactgcactgatgcttgttttctttattattcagggtatttatctgagtacctgtctgaaaaaggaggattgactgtggaatattttatgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataatgccggccgtcgatttgatccgcgaacgcctgcagacgctcgatccgctggtgttggaaatcggcgatgagagccatctgcacaaaggacacgcgggcaataccggcggcggacattatgccgttttggtcgttagcggccgttttgaaggcgtaagccgcctgaaccgccagaaaacggtcaaatcgctgctcaaagatttgttttcaggcggcatgattcacgcgctcggcatccgggcggctacccctgacgagtatttccatacggcggactgaatgaagtctgcccgaacatttcaatttaaaatttaaagagagaagattatgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataattctgaaaacgggatatggcggcaagacgttcagacaggcgttttgccgccgcgcaggacagggaataccatgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaatggcatttccaataccgatgccgtctgaagcctttcagacggcattgcacgttcaggtaaggaggacggcttatgcgtgcggtcatacagaaaacggtaggtgcaaaggtggatgtcgtgtccgaagccggcacggaaacctgtggcaaaatcgacggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcaggtgtcgctctgcaacgatgggccggtaaccatactgctggactctttcatgacgcggatttccccaaaaatgaaggttgttccggattgaaattgaatccgcaatgataaaatatcgacaatgaacgacaatacacacacccttcccccgcgccacctgtccgtcgcccccatgctcgactggacggacaggcactaccgttaccttgcccgccagattacccgaaatacttggctgtacagcgaaatggtcaatgccggtgcgattgtttacggcgacaaagaccgctttttgatgttcaacgaaggcgagcagcccgtcgccctgcaactgggcggcagcgatccgtccgatttggcgaaagccgccaaagccgccgaggcatacggttacaacgaggtcaacctcaactgcggctgccccagtccgcgcgtgcagaaaggctcgttcggcgcgtgtctgatgaacgaagtcgggctggttgccgactgcctcaacgccatgcaggatgcggtcaagattcccgttaccgtcaaacaccgcatcggtgtggacaggcagaccgaataccaaaccgttgccgatttcgtcggcacgctgcgcgacaaaaccgcctgcaaaacctttatcgtccacgcccgcaacgcttggctggacggtctttcccccaaagaaaaccgcgacgttcccccgttgaaatacgattacgtttaccgcctcaagcaggagtttcccgggctggaaatcatcatcaacggcggcatcaccaccaacgaagcaatcgcaggacacctgcaacacgttgacggcgtgatggtcgggcgcgaggcgtaccacaacccgatggtgatgcgcgaatgggacaggctgttttacggcgatacccgcagcccgattgaatacgccgatttggtgcagcgtctctacacatacagccaagcccaaatccaagccggacgcggcacaatcttgcgtcacatcgtccgccacagccttgggctgatgcacggtctgaaaggcgcgcggacttggcggcgtatgctttccgacgcaacgctcttgaaagacaacgacggcagcctgattctcgaagcgtggaaagaggtcgaacgggcaaatatgcgcgaatagggcggggctgtatgtgtgaaatgccgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggaggagttgttcgcggcggtttaaatccaatgcgggggcgagcgtctgtttcgaccatttctgcccttgtgcgttggtcagcagcggcaggtgggcatattgcggtgtcggaacgtccaaacactgctgcaaatagatttggcgcggcgtggaaacgagcaggtcttgtccgcggacgatgtgggtaacgccctgttcggcatcgtcggcaacgacggcgagctggtatgcccagtaaccgtctgcacgaagcaggacgaaatcgccgatgtcgcgggcgaggttttgggcgtaaccgccgacgatgccgtctgaaaaaccgataatgcggtcggggacgcggatgcgccacgccggctgtttgccttgcagtgcagggcgttggccggggtggcggcaacgtccgttatagacgaacccgtctgcgccccgccttgccccggcctgccagtctttgcggctgcaatggcagggatagaccagtccggcggttttcaggcggcatagggtttcttcatacagggcgtaacggcggctctgataggcgacttctccgtcccactcgaatccgaatgcctcaagcgtgtgcaggatatggcttgccgcccccggcatttcgcgcggcggatcgaggtcttccatgcggatcagccatttgccgccgtgcgcgcgcgcatcggcataggaagcgacggcggtcagcagcgagccgatgtggagcagcccggtcgggctgggggcaaaacgtcctgtgtacatatctggtacagcccctttatttaagactattaatcaaagccattatctcatctttattcagttccatcccgggctcttcaagcaaggttaaatcatatagggcattatattgctcttcggtagctgaaccatccataagagcaggcgagaaaaaatcaaaggctctatctgcaattctctcattacttgcatttctactaaccagtttcgtcaattctgtatattttgaaaagtttatggaaaaataaaacagcgaaaaagttttggtttcgctgtttttgatttaattagcactgataatcttcaaattcccacgaaaaaaaacgaagtaaataagtcaatgacttttcccaagtttcttttgaacattctttaagaattttctcaatttccgatttaataacagaatgattaaattcattcataatcatcatacccgccccccatttaaccctttgattttggaaacaattatgcaaaatccatttaggagagcatatgcgaacagaaaatatatctgcagcatcactatcatcagttcctatgtctaaatcaattcccacacaaaaattgtctttgatttcgggaacgaaatcttcaaaggcacaatcgtaaagattgatggctttcaattctaggttaatcattttatattcaatagtatggggaggtaccggatccttaaaaatcagatctgaataaatttcattgggtgaaatgatttcgattgcttttgccatgattctatttccttttgtgttagtgggtaatgtcgtgcattaacttcttgcccattaatatttttagggtgaatccttgatatgccgcactgtgtccggtcaaacgggcgatgccgtctgaaagcctttcagacggcatcgggaaaatgcctaagccaaaggcgcgagcagtttttcaaacgcttcttcaaactgtttcaaaccgtcttcctgcaaacgcgttgccaaggtttcgacatcgatgccgagcgcggcggtttcggcgagctgcgcttgtgcttcttctacgccttcggtcagcgtggctttggctgtgccgtggtcgataaaggctttgagcgtggcatcgggaacggtgttgacggtgtgcgcgccgatcaggctgtcaacgtagagcgtgtcgggataggccgggtttttcacgccggtagatgcccataaaagctgcacgcggtttgcgcctttggtttccagcgcggcaaattcggggctgccgaagtattgcgcccagtcttggtaggcggctttggcaagggcgatggcgattttgcctttgaggtggtcgggcagtgttgtgtccagcgcgccgtccacacgggagatgaagaagctggcgacaacttggatatgggcaacgctttgtccggctgctaagcgtttggcgatgccgcgcgcgtaggcggcgtaggctttgagggtttgggcgcgtgagaacagcagggtcaggttcacgctgatgccgtctgaaacgagggtttcgagcgcatcgatgcctgcgtcggtggcaggcactttaatcatcgcgtttttgcacccgatggcggcgtagaggcggcgcgcttcttcaaccgtgccttgcgcgtctttggacaattcgggcgaaacttcgaggctgacgaagccggttttgccgccggtggattcgtgttcggcaaggcaaacgtcgcaggcggcacgcacatcggcaaccgccattgtttcgtagcgttgtttggggctgaggttttgctgcttgagggcggcgatttcatcggcgtaaagcgcgtcgccggcgaaggctttttggaagatggcgggattggaagttacgccgcacacgccctgtttcaacatttgcgccaattcgccgctttgcactagcgagcgggaaaggttgtccagccagatttgttgtcctaatgctttaacgtccgataaaatggtcatctctgattcctttggatggataggcggggtttgagggcttatgctaccccgattcggaaattttgggtagttttattacagcaaaggcggatggcaatggcagaaaacggaaaatatctcgactgggcacgcgaagtgttgcacgccgaagcggaaggcttgcgcgaaattgcagcggaattggacaaaaacttcgtccttgcggcagacgcgttgttgcactgcaagggcagggtcgttatcacgggcatgggcaagtcgggacatatcgggcgcaaaatggcggcaactatggcctcgaccggcacgcctgcgtttttcgtccaccctgcggaagcggcacacggcgatttgggtatgattgtggacaacgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatataaggcgttgcagccgtttcagacggcatttgtggtaagatatgccgtctgaaaacaaggaaatcccatgcaggcaatttctcccgaattacaggcgcgcgccgccaaaatcaaactgttgatcctggatgtggacggcgttttgaccgacgggcgcatctttatccgcgataacggcgaagaaatcaaatcgtttcacacactggacggacacggtctgaaaatgcttcaggcaagcggcgtgcagactgcgattatcacgggccgggacgcgccctccgtcggcatccgcgtcaaacagttgggcataaattactatttcaaaggtatcagcgacaaacgtgccgcctatgaagaattgcgcgcgcaggcgggcgtggaagaagccgagtgcgcctttgtcggcgacgacgtggtcgatttgccggtaatggtgcgctgcggattgccggttgccgtccccggcgcgcattggtttacgcggcaacacgccgcctatatcacggaacacgcgggcggcgcaggcgcggtgcgcgaagtgtgcgacctgattatgcaggcgcaagggactttgggcgcggctttgaacgagtacatcaaatgaaagtaagatggcggtacggaattgcgttcccattgatattggcggttgccttgggcagcctgtcggcatggttgggtcgtatcagcgaagtcgagattgaagaagtcaggctcaatcccgacgaaccgcaatacacaatggacggcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaaaatgccgtctgaaatataaacccggttcggacggcatatgccgaccgaagatattgaagagatatttatgagtgcaaacgtcagccgccttgttgttcaaaacctgcaaaaaagtttcaaaaaacgccaagtcgttaaaagcttctccctcgaaatcgaaagcggcgaagtcatcggactgctcgggcccaacggtgcgggtaaaaccaccagcttctacatgattgtcggactcatcgccgccgacgcaggcagcgtaaccctagacggacaagaattgcgccacctgcccatacacgaacgcgcccgcctcggtgtcggctacctgccgcaggaagcctcgatattccgcaaaatgaccgtcgaacaaaacatccgcgccatcttggaaatcagaaccaaagataaaaatcaaatcgacagggaaatcgaaaaactgctcgccgacctcaatatcggacacttacgccgcagccccgcgccgtcgctgtccggcggcgaacggcggcgcgtcgaaatcgcccgcgtactcgccatgaaaccgcattttattttgttggacgaaccttttgccggcgtcgatccgattgccgtcatcgacatccagaaaatcatcggtttcctcaaatcgcgcggtatcggcgtactgattaccgaccacaacgtacgcgaaaccctcagcatctgcgatcgggcctacattatttcagacggcacggtgttggcatcgggaaaacctgatgatttggtcggaaacgaacaggttcgttctgtttatctgggtaagaacttcaaatattgaaaatatttttcagacgggcgacctaatatcgtcgggcaggcggcaaaaatacggatttatgttgtttttacataaattaattcaaatttaaaacattgacttaaacctgttttcaaagaatattgcccgatatgcttgcatgtcgtcccgtaatttggtttaatacgcatctcttaacgagacagacaaaggccagatagctcagttggtagagcaacggattgaaaatccgtgtgtcggcggttcgattccgcctctggccaccaaaaaaccgccttgaagcggttattttttttgcctgccgtttttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgcctgctgtttggtcagcttggcggcgggtatttgataaaaataccgggacgcggcttccgcgccgaaaacgccgtagtgccattcgattgagtttaaatacagttcaaaaatcctgtctttgtcggtaacggcttccatcatcgcggtaatcgccgcttcttcgcctttgcggatatagctgcggctttcgtttaaaaacaggtttttggcaagctgctggctgatggtcgagccgcccgccttcactttgccgctgttccggttgcgcctgatggcgttttgaatgccgccccaatcgaagccgccgtgcccggcgaaacgggcatcttcggaagcaatcagggcttttttcaggttggtggaaatgcgtttgtagggcatccagcggtaatccagtgcgacatcgcgaccttcctgttcaaactgcttcatccgcatcgacataaaggcagtccgatggggcgcgacggcgcggtaggtaatgatgttgccgtacacataggcattgaaaaagataaagatgccgacgggcagggcaatcagccatttgatgatgcggaacatgtttatagggctttcatgtattcgataacggggcggatatcgggcgtaaatccgcgccagagggcgtaggaagccgccgcttgaccgactagcatacccagtccgtcggcagtttttttcgcacccgattgtcgtgcaaaatctaaaaacggttttgccgcgcagccgtacaccatatcgtaggcaagcgcgcagttttgaaaaatatcgggcggaatatcgggaatctgaccgtttagaccgcccgacgtgccgttgatgatgatatcaaaaccgccgttcacgtccgccatcgggacggcttcaatgccgaaaagctgcgccaattcctcggctttggcgcgggtacggttggcaatgacgatacgggcaggacggtgttctttcaaaacaggaatcacgccgcgcaccgcgccgcctgcgcccaaaagcaaaatggttttgccctcgatggcaatatttttgacctgcgtgatgtcgttggtcaaaccgataccgtcggtgttgtcgccacgcagcttgccgtttttcaacggaatcagcgtattgaccgcacctgccgccaatgcgcgttcggaatgctcgtccgccagatgaaacgcttcctgtttgaacggtacggtaacgtttgccccgcaaccgcctgtttcaaaaaatgtcgaaaccgcctgcgcgaaaccgccgatgtcggcgcaaatgcgttcgtattcaatgtcaacgccttcctgaagggcaaattgttgatgaatttgcggcgatttgctgtgggcgacggggttgccgaaaacggcgtagcgggggagggcggtcatggtcgtgttccaaaagacgggaaggctattttataacggcggcgtacagatggaaacgatgccgtctgaaaccgccttcagacggcatcgtttcctgtatcggtcgggaaaaatccggatgcggtgcgccggcttgtccgcattgttgacaatcttgccgtctgaaactatattttccggcttgaaatttgacgcaaaaccggtttcagacggcatcggcgtggtaaaatcgtgccgactttgcgtcaagccgccgcgttccgcatattttgctatttcccttttccaggagctgaaaaatgtctattaaaaacgccgtaaaattgattgaagaaagcgaagcccgctttgtcgatttgcgctttaccgataccaaaggcaagcagcaccactttaccgtgcctgcgcgcatcgtgttggaagaccccgaagagtggttcgaaaacggtcaggcgtttgacggttcgtctatcggcggctggaaaggcattcaggcttccgatatgcagttgcgccccgatgcgtctacagccttcgtcgatcctttttatgatgatgcgactgttgtgttgacttgcgacgttatcgatcccgccgacggtcagggttacgaccgcgacccgcgctccatcgcccgccgagccgaagcctatttgaaatcttccggcatcggcgagaccgcctatttcggtcccgaacccgagtttttcgtattcgacggcatagaatttgaaaccgatatgcacaaaacccgttacgaaatcacgtccgaaagcggcgcgtgggcaagcggtctgcatatggacggtcaaaacaccggccaccgcccgaccgtcaaaggcggttacgcacctgttgcaccgattgactgcggtcaggatttgcgttcggcgatggtaaacattttggaagaactcggtattgaagtggaagtgcaccacagcgaagtcggcaccggcagccaaatggaaatcggcacgcgctttgctactttggtcaaacgcgccgaccaaacccaagacatgaaatatgtgattcaaaacgttgcccacaacttcggcaaaaccgccactttcatgcccaaacccattatgggcgacaacggcagcggtatgcacgttcaccaatccatttggaaagacggtcaaaacctgttcgcaggcgacggctatgccggcttgagcgacaccgcgctctactacatcggcggcatcatcaaacacgccaaagccttgaacgcgattaccaatccgtccaccaactcctacaaacgcctcgtgccgcactttgaagcgccgaccaaactggcatactccgccaaaaaccgttccgcttccatccgcattccgtccgtgaacagcagcaaggcgcgccgcatcgaagcgcgtttccccgatccgaccgccaacccgtatttggcatttgccgccctgttgatggcgggtttggacggcattcaaaacaaaatccatccgggcgaccctgccgataaaaacctgtacgatctgccgccggaagaagatgcattggtgccgaccgtttgcgcttctttggaagaagcactggccgccctcaaagccgaccacgaattcctcctgcgcggcggcgtgttcagcaaagactggatcgacagctacatcgctttcaaagaagaagacgtacgccgcatccgcatggcgccgcacccgctggaatttgaaatgtattacagcctgtaagcacgtctggttttcagaaaagcaatgccgtctgaacacagtttcagacggcattttgcatttgaacggcaaaccggcggcgcggggcggcatttttcagcaggcgggcgatatttgctacaataggcttttgttttttttgggctgcacgaacgatgactgcatcgaaatcaggttttatcgggcaaatcttttcccgcaatatgcttgtctgtatttttacggggtttacctcggggctgccgctgtactttctgattaacctgattccggcgtggttgcgcagcgagcaggtggatttgaagagcatcgggctgatggcgttaatcggtctgccgtttacttggaaatttttgtggtcgccgctgatggacgcggtcaggctgcccgttttgggacggcggcgcgggtggatgctgctgacgcaggcagggttgctggcggctttggcggtctatgcctttttaaacccccgtaatcatctgccgctgattgccggcttgtcggtgcttgtcgcttttttttccgccagtcaggatattgtattggatgcgttcaggcgcgagattttgtcagacgaagaattgggtttgggcaactcggttcatgtgaacgcctaccggattgccgccctgattcccggttcattgagtttggtgttggcagacaggatgccgtggttagaagtatttgttatcacttcattatttatgctgcccggccttctgatgacgctgtttcttgcgcgcgaacccgtgttgcctcctgccgttcctaaaacgttgaagcagaccgtggtagagccgtttaaagaattttttacgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgcgaaaaatgcaggactgtggccggcagtggcggcaggtatcttgggcggtgtgtggatgctgaaaatcggcgtaaacaaagccttgtggctattcggcgcggtgcaggctgtaaccgttttggggtttgtatggctggcagggttcggacctttcgacacggtcggcacaggcgagaggctgatgctggcggcagttatcggcgcggaagcggtcggcgtggggttggggacggcggcgttcgtatcgtatatggcgcgtgaaaccaatcccgcatttaccgcaacgcagcttgcgctgtttaccagcctgtccgccgtcccgcgcacggtcatcaattcctttgccggttatctgattgaatggctcggttatgtaccgtttttccaactgtgtttcgcactcgccctaccgggtatgctgctgctgctgaaagttgcgccttggaacggggagaaaactcaggatgcaggcagatgaacgcgtcaaactggagcgtttacctgatattgtgtgaaaacagcgcgttctattgcggcatcagcccgaatccgcaacagcggcttgccgcccacacaaccggtaaaggcgcgaaatatacccgcgtattcaaaccggtggcgatgcgtatcgttgcaggcgggatggataaaggaacggcactcaggcaggaaatcgccgtcaaaaaactgaccgccgcacaaaaacggcaattgtgggagcaggcagaaaaaatgccgtctgaaacctgacggttcaggttcggacggcagttggcagcaatcagggaaaagcggggcaggcggtaaggaaaaccgacgtttcaacacacaggacggtacataaagcgtcgccctatgaaagtgaaggcatatatcagtattttttatacgccaacagaaaagaatacgatgaactgtttgttggatttgtattgattaatcagtatattttttatgccggggtatttttccttatcggtatcccttcttttatgaggatgcctgccgctcatataaagaacgggaaaatacgatgggaaaatacggtacagccctcgacatcgcacaatatgtcaacttatagtggattaacaaaaatcaggacaaggcgacgaagccgcagacagtacagatagtacggcaaggcgagacaacgccgtactggtttttgttaatccactatatttgtttgttttatattgtaagtatacgtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgaagatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagcaaaagttagtaaattatttttaactaaagagttagtatctaccatgaatatattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaaaacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatatgaagcttatgaagataaaagacatattcctgaaaatccatattttcatgaattttactatattaaaaaaggagaaaatccggcgattattactcatcggaataatcgaataaaccaaactgaagaagatagttatagcactagcgtaggttcctgtattaacggtttcacggtacggtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggggtggaaaacctatgggatgatacggtcggtaaaaagacccgtttaatgtgtatttccgttttttggattgtggttttcaatttgtagcgaatcggattcggcatatacggcattgcaaaaagcgtttgactctccaatgccgtctgaaaaccggtttcagacggcatttgcgttcagtgagaaaggtcgcgcctgccgcccgaacgtctcgccgcagcctctgcataacggcgcacctctttttccaaattttccaagttcaaaggaaaatcaggcagtctgtctccctgtttctcttcgcggacaatccgcccgccatccaaataccacgtctgttgcgcatgataggtctgcatatccgccgttacgccatccgctttcaatgctaccgtcgaagattgtgcaataaaaagatttccgtttttcaaataatattcgaaactctggcgtttttttccattgtcgaaactccaatagactttttgcggcagaccgtccgcatcatagccgaccacaagactgttcgccttcatccctcggggcatcaattcccgcatattctgataaaacacagaattgcgcgagtccgacgcaattcggttgctctctttgcggaagtcccaaaccttctgctcgtcattcgcgacatcccggtatttcgccaaatatacctgggccatctgataacacccgaggcaatgctcataaacatcttccccgattttcccgcgccccgccgcatcaaataccgaaccgtctggttgccaaacaacccgatattctcctgtcgtttcataattttccccgtgaaccgttccgccgtacacatttacagaaaacggacgatcgttccgatacagatattcggcattaacaaatgcttccggcgagcgttgcgaaagcgaaaccgcaaccaaaccgccctcgccgatatggtaatccagccaaacctctttcccatgttcctgctccgttacgtgaaaccatttcgccttttctttcaaacgactgagccggatagcgagcgcgagataatccttctccgactgcaacggaccgtcatccacagttccggcaagattttcctccgtccttatcgattccttcacgatgacaaccgccctgtcggcatttcggaacaggcgggcaagtttcgccacaaaagcattcggatttttaggtacttcagttgccgtatcgctcaaaaaccaacgcggattaatctcataggcaatacccgttcccagccaaaaggcaaatacaagtgcaaaaaatgacaacagtaccggtttgaattttttaaacatatttatttttcgtttaacagaatatatcgattatatcagacgagctttgattgccgggttttgctattttttgttgtaataatcaaattgcacgttgactatgtctttctcggtaaaaatataacggagcattgttttaagcctttcataacgttcattaattcctacgctatcaggtagccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaacaagtaatatttcttctgaagttttttaactcacacataatacacataataattaatctccaatacgatttaggtttttatcaaatgtaccgtttcttgtttcttttctgtaatgttattcatcgtagtaaggttctgttgaataattgtctttgcccccggcaatgatagtaacaattttcccttttgcttcccaagcttgtactcctatttcatcaaactcatagacatatgtcggataagattcatttgataaataatatttatcaacaccgtatgatttagggtaatggaaaagctgtttaaaatcttcaaaattcagacctattatattaacgcccataaaatatagctcctgataacaaaatatcgaaataattttgtttttttttttgacggaaatgagtaaatttgagtcgggagattcataatattctgttctaaactcatcaggaggttcatacataaaagtttccagtatgtttttgtactgtgttatatccgcaccaaaacggaatattcctacagaagtaaaaggtaaaaattcgggagttttaacgaccgcgtcgaccatgctcttctccttttgtttttcgattggcatttttggcaatatttctgattttttgcttaatctttaagcgttcatttttggacattccgggaataattttatttgttaattcagcaatttttgattccgctgatatttgacttcgaccgccatctccatgtttttcattcttggagcttcctgttcttttaggcggacaagaattatgaacccaaaccccttccgtttccgcctgattacccttgacgaagtaagtatgccaatcggcaacggtcagattgtaggctttgagcggttttggtttgacaacggttttgcggacggtttgggttctgccgctttcggataacagcctgcttcccgctttcaaatcttccgctttaatccatttgccgtccgaataaaacggatggatgcggttggaaatcaggatttggctgttgccgatgccgtctgaaagccggatatcgcttcagacggcattttgattgccgggttttgctattttttgttgtaataatcaaatcgcacgttgactatgtctttctcggtaaaaatataacggagcatcgttgtgaatctttcataacgttcatgaattcccacactatcaggcaaccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaataaggaacgtttcttataatatccttgaactcacacataataatgtatctccaatataattaaacttttcgtctcaatctacctttactatgttgtattggaaagtaaaaaaatttccagtcctctacatctagatcagtaaaaatataacggagcattaccctgaacctttcataacgctcattaattttgacacttttaggcaaccaagtagaagctttaatttcaaaaagtttccaattttgaaccattaaaaaatcaataatggtaccgattccaatcacgatgtcccttggtatatccatcggataaggatatttttttctaacctcaattaaatcattctccaatttccaatattcttcatcatcccacaccccgtcatcataccatttgccaataaatgaattttcgtcatactccttaaaacaagggatgtttcttctaaaatccttgaactcgcacataataattaatctccaatacgatttaggtttttatcaaatgtaccgtttcttgtttcttttctgttcagtttttcgggtgaagatgcctctttccaagcacctccattatgtgaatctacatcgcgtgatatataactctttccttttttaaaaatagcagcatcatttctcgttctttcttttatttttctatatcccaattcctttgctgctgcatatgcttctgaatcattcccatatatgggggtagatggtgtttttcttggcggacaatcattatgaacccaaaccccttccgtttccgcccgattgcccttgacgaagtaagtatgccagtcggcaacggtcagattgtaggctttgagcggctgctgtttgagggtaatgttttgaaccgtctgttttgcaccgctttcggaaagcagggtgtcgccttttttcagacgacctgcctgtatccattttccttgactgtaaaacgggtggattttattggaaatcagggtttggttgttgccgatgccgtctgaaatttcaatgtaaacggtttcttgatacggattgccgtatcgggcggtaacgggtttgtatcccgtttttccgcttgcctcgtccttggcgaagacgcggtcgccggttcggatacgggcaatggctttgtagccgtctgccgttttgaccaaggtgctgccgtggaaggagcaggtgtaggatttttaaagaacttagttctcaatatcctgtttcattcatcaaaatgccgtctgaaagctgaataccgcttcagacggcattttggtggttgggtttttaagccaacctacgcttactgaaaaccaaattgagtttcagacagtttttaggtttgggtgtccaatctaacttatatttgtccatttaattagtcgtttgtatcaaatttccattatttattttccaatttactttataattatcttcataataatctaattcaaaaaaacctgatatttcaatatccaattccattattgttttaatacatttttcaaaataaataatgaaataagattttacgcatgcaccaaaaaaaatatagctgctccaattaaaactatttgtcgggaaaacccacccgcttttatatatttttgcagattctttctcttcgatattaaagggacaattattccaaaaattattaatgttttcttggatgatttttatatcatcgtcagagcattcaatccatccttttatggaaacatatgatgccatgtttaatctcctaaacctgttttaacaatgccgccttttgattcaatatatgacttaacttgtgaatgaacaccgtatttaaaccaaaattctgcacgttttccctgttggtttgctgcttcgatggttgctttaatttgctttctatttttttgatttaagaaatttttaggtttatctattgctgaaattgttcttttggcttgtattaaagcatcattcgtaacagcgtcaatttctctgccgttaataaattttgatgaaccatcagtttttcttctaattaaatcttcataatgtatatctagagcttctctatactttgcattttgatataactgtctcgcactatcagacaaagccaatttctttttataagaatcagcaaaatccccgctaaccgcagccttccctggttttgccgcctttgccaacttcgcgactttggctgctgcggcaacgttgaagacggcttcgacggtttcggcggcattgggattttcctgtatccaccggtcaacggcttcgcgcgtattcttttcaaagcccgccacgctgcccaagccgccgatgacggcgaatttgccctcggcgggcaagggggcgatgttgcgcattgcggctttgtctatggcatagcgcgttccgtacagtatgtcgcctatgcccaaggcttcgcccgcgctgataaaggggttgagcgcgccggcggcgacgccgttgataaactccatgctgttgccccagcggtcgagcttggcattgtgctcgaacatttttctgttggcttcatcggcgcggtcggagaaattgctgccgaggttgctgtaattgtcggatatgcgttgccggatgctgcgggtgtcggtcggattgagtttgatactgcgggctgtgccgttgacgtgataggtgtattcgtctcgtgcgcccgtaggtttggggtaattgccgcccttcgggccgtcgtaggcatcggcgggatgatgttcgtgtccttcccagttgagccggtatacggtaaagccttcgtcaacgttgcctttttcttcgctcgcgctgtcggcggcgtggttgtcgaagggggcgtgttcttcgtgtccgtgtccggaaaagcgggtgtggtagccgattgtgccgttgatgtttgcctgttggatgagcaggttgcccatctggtgggtatagtcttggatgacgttgattttgccggtgcggtcggaaacgctgccgcgcgggtcgccgaagaggtggtatttgccgccgggttcgtagtgctgccgttgggcgttatcggtaatgaacgggtcttgcgccaagtccgccgcgagggcgggctgtatgagtgcggccgccgctacggcgcaggcggcaaggaggtttgtcagtctgcgcagcggtttcacggtttatcctcctttgcggcggcggatgacttcgttgccgacatcgggttttttaccgttgttttgtttgaagtcgggacggttttgggcggttgtgtcgccgtagggggtaatgtcggagaaatcgaccatcaggcggtctgaggctttgacggttttgctgactttgtaagggccggtccaaagggcgtattgttcttggtattgggattcgtaggcggcggttttaggggtaatcagcagtttccggctgtcgcggtcaacggcgaaatattcgagcttggtttgggctttaagggtttcggcgttgtagaggtgcagttcggtacggctgcggacggtgccgaatacgtcgacggttacgaatacgtcggtgtcggcgtattcgggcggtacgacttcgatgccgcgcaggtagaagacggtttggatgaggttggtcaggaaggaaacgtcgcgggggttggcgagcagggtttcgttgcggtagtcgcccgtgccgttgacggacagtccggcggagcgttcgcctttgcgtccgctgtttttcgtcagggcggcggcgggggcgttcaaaagcgatgtggaagtggttacgctggagagcgcgtcggatttggtggtggcggtagtgtcgtaggcggggtagctgtattgggtggcactttcggggttgttgtggtagccgccgcgtatcagtgcgtcgatagagtagcgtccgccgcttatgttgcccgaaccttggtcgcccataacggagacgtaaagggcggctttgcgtccttttagggcggacaaatccatttctttgacggcggcgcgggacgatgcggcgacgagttcttgttcgacggcaaagcgtttgccgccgccgtgggcgggtatgccggtcagtgtgccgcaggctgtgaggacgagggggatgaggaggagcagggttttcatagcggggtttgtttgatgttgaacggattttgagtgtaaagggattttaagggtttgtaaacaaaaggggcgaaaatgccgtctgagcggcggaaatggctttcagacggcatttgcgctcaataataatatcccgcgcccagaatacacggtttggatgcgccggttgctttgtgcggactaccgggaatgcgattaatccaacacgccgccaaccacgcaaatgcggcggcttccacccattgcggatcgaggttcaggtcggcggtgctgtgcagggaaacgcgtgtgccgaaacattctgccaaatccgccattaaaacaggattgcggatgccgccgccgcaaatgtacatttgacgggcatctgccgctgcgtgtgagacggcgtcgcaaacggtttgcgcggtaaaacgggaaagcgtccgcaatacgtcgtatcggttttcgccgccgtcaaggtaggtttcgagccaatttagggcaaacagttcgcgccccgtgcttttagggtggggttgtgcgaaatacgggtgggcgagcagcctgtcgagcagttgcggcaatatgttgccttgtgccgcctttgcaccgtttttgtcgtaaggaagctgccagtgtgcctgcgtccacgcgtccatcagcatattgcccggccctgtgtcgaagccgaaggcgggtgcgtcgggggggagtacgctgatgttggcaatcccgccgatgttcagtaccgcgcgtgtttccctgttgtcgcggaacagggcttcgtgaaaggcggggacgagtggcgcgccttgtccgccggccgcaaggtcgcggctgcggaagtcgccgacggtaaaaatccgcgtccgttccgccagcagcggcaaatcggcaagctgtatgctgtaaccgtgttccggcgcgtgtcggacggtttgcccgtggcagccgagggcggtaatgtcggacggtgcgaggttttgactgcacagcagttcggcggcggtttgcgcatataggcggctgagttcttgcgacaaaatcctgctgcggtgcagttcgtctgcgcctgtgtcctgcaaatccagcaattggcggcgtaacctgccggggtagggggtaaaggcgtgcccttccgcgcccagccatttgccgccgtccatccgtatcagtacggcatccgccccgtccatgctggttcccgacatgatgccgatgtaaagctgtgtttccatcatcactcccaaactggtgcaaaacgccattttaacgtgtattgacgctcgtataccgatttgccgccgcagtgtaaataaagtgtaaataaatgtttcaagacggatggaaaaatattataatgcgcccgcaacatccagtagtagaagtgtcatacaaaccgtttccggcagcagttttgcattcggtcaggtttgggggtattcggatgcggttaggaaggatgcgtctgccatatcccgaaacggcagttcgaccggaggcagcagtacagtgtcggcaacactcatgatttccaccacattaaaggaagattgccatggctcaaatccaaatgagcgcaaatgttaaaaccatcaacgccgtctttgccgccatgctggtaggtacagtcggctattttatttattggggcttgggttatacccattacaattacgccgccttattcattattgccacgatgttcggcgtgtttatggcgttcaacatcggcggcaacgatgttgccaattctttcggcaccagcgtcggtgcgggtacgctgaccatcccgcaggctttgctgattgcggcggtatttgaggtcagcggcgcggtcatcgcgggcggcgaggtaaccaataccatacgcaaaggcatcgtcgatttgaagggtgttgatttcgaacccatacagtttgtgtttattatgatgtccgcgcttttggcggcggcgttgtggctgttgtttgcctcgaaaaaagggcttccggtatctaccacccattccattatcggcggcattgtcggcagcgcggtatgtatggcggtaatgaacgatgccgcatcgggcgatttgatacgttggggcaagctgggcggtattggtgtttcttgggtattgtcgcccgtgttgggcggcgcggtgtcctattttctgttttcgcgcgtcaagaaaaacgtcttagattacaacgcttgggcggaaggcacgctcaagggcatcaagcaggaaaaaaaggcctataaagaacggcaccgcctgtttttcgagggtttgtccgaagccgaaaaagtcgagtacgccaccaaaatggcgcacgacgcgcaaatttacgacgaacccgaattcgatccgcaagagctgcaatcggagtattaccgcggtctttatgcgttcgacaaccgtaaaaacaatgtcgattcctacaaggcactgcattcttggattccctttatcgcttcgttcggcgcgatgatgatttccgctatgctgattttcaagggcttgaaaaacctgcatttggggatgagcaacgtcaacagcttcctgaccatctttatgataggcgcggcggtgtggatggggacgtttgtttttgccaaaagcctcaagcgtaaagacttgggcaaatcgacctttcagatgttttcatggatgcaggtctttaccgcctgcggcttcgcattcagccacggtgcgaacgatatcgccaacgccatcggtccgtttgccgcgattatggatgttttgcgtaccaacagcgttgccgcgcaaaatgtcgtccccccgattgcgatgctgactttcggcatcgcgctgattgtcggtttgtggtttgtcggtaaagaggtgattaaaaccgtcggtacgagtttggcggaaatgcatcctgcttcgggttttaccgccgaactgtccgccgcctccgtcgtgatgggcgcgtcgctgatggggctgcccgtgtccagtacgcatatcttggtcggcgcggtactcggtatcggtctggtcaaccgcaatgccaactggaaactgatgaagcccatcggtttggcgtgggtcattaccctgcctgccgccgccgtattgtcggttgtctgctacttggttttacaggcagtattctgattgtaaaatactgatgccgtctgaacccgtgttcagacggcattttgttgatggaatgtgcgggcttgtgccttatgcacaatctgttctgtcgggatatgccgtttggtatagtgattaacaaaaatcaggacaaggcgacgaagccgcagacagtacagctagtacggcaaggcgaggcaacgctgtactggtttttgttaatccactatatcttggtttcggaacggtcggacacaaaggtgcggaacgttatgatatgccgccgcctgttcttgaaaacacttatcctgccggcagcaaaatgccgtctgaaaaagcctttcagacggcatttgtacgttagccacaatcacactgtttgcgaatatttcgccttggtttctttatggcgcaggtggtaatcgaagaccatggcgatgttgcggatgaggaagcgtcctttcggggtaacggtcagcccgtggctgttcaggcgcaccaatcccaaaccggcgagtttttccaaatccgccagttcgtctttgaagtagcggtcgaacgggatgccgaacatactttcgtaaatccgatagtcgagcgcgaaacggcacatcaaatcctgaatgatgttgcggcgcaggatgtcgtcctgattgagctggtagccgcgcatgatgggcagtctgccttcgtcgatggcggcatagtaggcatcgatgtcgcgttcgttttgggaataggtgctgccgattttgccgatggacgacacgccgatggcgaccaaatcgcaatccgcgtaggtcgaatagccttggaagttgcgctggaggaagccttctttgagggcgatggagagttcgtcgtcaggtttggcgaaatgatccatgccgatgaagacgtagccgcgttcggttagggtttggacgcagtattgcagcatatcgagcttctcttcgctgtcgggaacggcggcggtatcgatgcggcgttgcggtttgaacacgtgcggcaggtgggcgtagtgataaagggcgaggcggtcgggatcgagcgacaaaacggtatcgatggtggttttgatgctttccgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatctgttcgtcgctcaaaaaggtcggcgtgccgccgccgaagtgcagttgggcaagctggtgccgtccgttcagatgtggagcgagcagttccatttctttttcaagatattcgatgtaggcatcggcgcggcttttgtctttggtgatgattttgttgcagccgcagtagtagcagatggtgttgcagaacggaatgtgaatgtaaagggaaagcggtttgtttaacgcgcccataccgcgcaaatgtaaagctttgatatattcgccttcgcggaaaccgtcatggaaacggtcggcggtagggtaggaagtgtagcgcgggccgctggcgggcaggctggcaatcagcgcgcggtcaaactcggggcggtcatcgtttacattgtgattgttctgtatctgaatgattttcatggtgtgtgtgtgcggttttatgatgttagtcaaattttggatagtttggtagaatgccacagtatgataaacctgtcttgatatgtgtcaataagcacatatagtggattaaatttaaataaggacaaggcgaggcaacgccgtactggtttaaatttaatccactataatcatgatggggcaaagcgcacaaaaaggtacggtatggcttcgcataatactacacatcagatgaaaacgctgtgttcttcctgttctttgcgggaactctgcctgcctgtcgggctgctgcccaacgagctcagccaactcgatgccgtcatccgtcaaagccgccgcctgaaaaagggcgaatacctgttctgtgtcggcgaagcctttacctcgctctttgccatccgttcgggcttcttcaaaacaaccgtcgccagtcaggacggccgcgatcaggtaacgggtttctttatgtcgggcgaactcatcggcatggacggcatctgttcccatgtgcacagttgcgacgcggtcgccttggaagacagcgaagtgtgcgaactgccgtttacccacatcgaagaactggggcaaaacatccccagcctgcgtacgcacttcttccgcatgatgagccgtgaaatcgtgcgcgaccaaggtgttatgctgctgttgggcaatatgcgcgccgaagagcggattgccgccttcctgctgaacctttcccaacgcctttattcccgaggttttgctgccaacgacttcatcttaagaatgtcccgcgaagaaatcggcagttatctcgggctgaaacttgaaaccgtcagccgcacattatctaaatttcatcaggaaggattgatttccgtcgagcataagcacatcaaaatcctcaatctgcaggtgttgaaaaaaatggtgtccggctgctcgcacgccatttgattaacccgtacgaacatttcagacagcattctcaataaacacagggcagacgaaaacatctgtcctgtttgttgtatctgccgcaaagtgccgtctgaaaaccggcagccgcctaaatcgaaaaatcctcgctgatgggcgtgtacagaatcctatccaccttctcgcgtgtcaggtgcggcgcgaacgcttggataaagtcgtaggcatatccgcgcaaataagtatcgctgcgcaaagcaatccacgtcggcgacggctcgaacaggtgtgccgcatccacaagctgcaaatcgccgtccgtatccgggttgtacgccattttcgccatcagtcccacgcccaaacccaagcgcacataagtcttcaatacgtccgtatctgccgcagccaatgcgacatcgggttgttccaaacgggctttggaaaatgcccgcgcgatgctgctgcccgcattgaatgcaaattcataagtaatcagcggaaacctcgccaaatcttcaatacggagggggtttctgcattcgagcaaggggtggtcgttcggtacgataaccgcatgagtccagtcatagcagggaagttttcccagttcgggatggtcgtctatccgttccgtaacaatcgccaagtccgcctcgcctgaggtaaccatacgtgcgatggcggcagggctcccctgtttgatggtcaggttgactttcggatagcgtttcacaaaatcggcaacaatcaagggtagggcatagcgtgcctgagtatgcgtcgtggcaaccgtcagcgaaccgctgtcctgtccggtaaactcgctgccgatatttttaatgttctgaacatcgcgcaaaatacgttccgcaatatccaaaaccaccttgcccggctgcgagaccgaaaccacgcgcttgccgctgcggataaaaatctgaatgccgatttcttcttccagcaatttgatttgtttggagatgccgggttgcgaagtaaacaaggcttcggccgcttcggaaacgttcaggttgtgctggtaaacttctaaggcgtatttcaattgttgtaatttcatggcgggtcggtgtgggtctgtgtcgggtggctgaacattgtttataatttatcatattttcttgccggtacggtatggggctttgccgttgtgtttgttgtttttgtgcaacggcaatcgtgcgatatggaaaaaatccccctaaagtaatgacacggaattgatttttcggcatgatagactatcaggaaacaggctgttttacggttgttttcaggcgttgagtattgacagtccgccccctgcttctttatagtggagactgaaatatccgatttgccgccatgtttctacagcggcctgtatgttggcaattcagcagttgcttctgtatctgctgtacaaatttaatgagggaataaaatgaccaaacagctgaaattaagcgcattattcgttgcattgctcgcttccggcactgctgttgcgggcgaggcgtccgttcagggttacaccgtaagcggccagtcgaacgaaatcgtacgcaacaactatggcgaatgctggaaaaacgcctactttgataaagcaagccaaggtcgcgtagaatgcggcgatgcggttgctgcccccgaacccgagccagaacccgaacccgcacccgcgcctgtcgtcgttgtggagcaggctccgcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgacaaatacaatcaggccctgtccgaacgccgcgcatacgtagtggcaaacaacctggtcagcaacggcgtacctgtttctagaatttctgctgtcggcttgggcgaatctcaagcgcaaatgactcaagtttgtgaagccgaagttgccaaactgggtgcgaaagtctctaaagccaaaaaacgtgaggctctgattgcatgtatcgaacctgaccgccgtgtggatgtgaaaatccgcagcatcgtaacccgtcaggttgtgccggcacacaatcatcaccaacactaaggctaggcaatatcttgccgatgcatgaggttagtggattttgtaccaggtactgttgcaatattcgtgaaacgtcggtcggcatcgatgatgtgaaacaaacccccgcttttgcggggtttgtttttttgggtggttttctgaaacggctatcgtcagaatcggggtgcaggttcggattcggattcagattcagattcagattcagattcagattcaggtttgtgtcccattgccgcgctttatagtggattaacaaaaatcaggacaaggcgacgaagccgcagacagtacaaatagtacggaaccgattcacttggtgcttcagcaccttagagaatcgttctctttgagctaaggtgaggcaacgctgtactggtttaaatttaatccactatatcggttgaaactctgattttaaggcggtaggatgtgggtttgcccatagaaagggaatcctttctgtatcaagccctgaaagggataattcatacaaattcacgcctttccccctcattgggaaatggatggaatcgtgccagatgtgtgcggcactgtatgccggatatggttttatcatcagcccttttcggttgaaaccccgtcagttgcagcgattgagcctaatcggtggcggaagttgccgctttgcattcggggcggcgtgcagtgcggtgctttgatatgccgtttgtgtgttgaaacagggtggtcggtgcatacgggtacggtatggccaaagctaaaagtgaaatacgctgaaacactgaatgagccgctttattgtttgtacggcctttgctgccttgctatgatttaaattggattcgcccgccggatattttgggatatgaaagaatttgacttcatcaaacggtatttgcaaacaggcacggataatgatgtcgtattgggcataggcgacgatgcggcgattgtccgcccgcgtgaaggcttcgatttgtgtttcagtgcggatatgcttttgaaggacaggcatttttttgcagatgtcaaacctgaagacttggcttggaaggttttggccgtcaatatttcagatatggcggcgatgggtgcgataccgcgttgggtgttgctgagcgcggctttgcccgaattggatgaggtatggctgaaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtatcggtatggcggcggcggctttgaactgccgtctgaaacggtgtgtgttgccagatgaagtgtttgccgaatgcgaacaaaagctgctccatcctgaaccaagggttgggctggggcttgcgctgttgccgtttgccagggcggcgcaggatgtttcagacggcctcgcgcaagatttggggcatatcctgaccgcttctggcaagggtgcggaaatttgggccgattcgctgccgtctttatccgtattgaaagatattttgccccgagcgcaatggctgtcttatactttggcgggcggcgacgattacgagctggtgtttaccgcgccggaaagttgccgcagccgcgtatttgatgcggcggaacggtgcggcgtgccggtaacgcgcatcggcaaaatcaacggaggatgccgtctgaaggttttagatgccgacggcagggaattggaactacattctttaggattcgatcattttggctgattttaaacctgactttgcgtggctgttgaaacggccgttgtgttttttggctttcggtttcggcagcgggctggctccgttcgcgccgggcacattcggcactttggcggcactgcctttggcgtttgtgctgattttgctcggcatagacgggctactgctggcttttttgtgtatcgtgctgtttatgtggggcatacgcatttgcgcttatgcggaacgtgaaacgggtgtcagcgaccacggtgggattgtttgggacgagattgtcgccatgctgtttgtgctggcgtttgtgccgttcaggtggacgtggtggctggcggcatttgtcctattccgtctgtttgacgcgctcaaaccgtctcccgtcggttggtttgacaagaatctgcacggcggtttgggcattatggcggacgatatggcggctgcggtgatgactttgattgtcttgaggattgcaatgctgttttaaacggtgctgccttgtaaaaatgccgcctgaaagcctttcagacggcattgtttcggaggttaacgcgttaccggtttgtatttgatgcgtttcggtttcgcgccttcttcgcccaaacggcgtttcttgtcggcttcgtattcctgatagttgccgtcgaagaacacccatttagagtcgccttcacacgccaagatatgcgtggcgatgcggtcgaggaaccaacggtcgtgcgaaatcaccatcacgctgccggcaaattccaacaatgcgtcttccaacgcgcgcagggtttccacgtcaaggtcgttagacggttcatccagcagcaatacattgccgccgctcaacaaggtttttgccaagtgcagacgaccgcgttcgccgccagacaattgacctgcaattttgctttggtcgctgcctttgaagttgaaacgccccaaatattggcgggcgggaatttcaaactgaccaacctgcaaaatgtcgcggccttcggcaatgttgtcgaacacggttttgtcgttttgcaaaccttcgcggctttggtcaatcaagctcattttcacggtttgtccgattttcacctcgccggaatcaggctgctctttgcccgaaatcattttgaacagcgtagatttacccgcgccgttcgggccgatgatgccgacaatcgcgcccgcaggcactttgaagctcaaatcgtcaatcagcactttatcgccgaacgatttggaaacatttacaaattcaatcacttcgttacccaaacgctcggcaacgggaataaagatttcctgcgtttcattgcgtttttggtattcgtagttgctcatttcttcaaaacgagccaaacgcgctttggacttggcttggcggcctttggcattttggcgcacccattccaattcctgcttcatcgccttcacgcgcgcggcttcggattttgcctcgttttccaagcgtttttctttctgctccagccaagacgagtaattgcctttccacggaataccatggccgcggtcgagttccaaaatccattcggcggcgttgtcgaggaagtagcggtcgtgcgttaccgcaacgactgtgccggggaagcgcacgagaaattgctccagccactcgaccgattccgcatccaagtggttggtcggctcgtccagcaaaagcatatcgggcttgctcaacaagagtttgcacaaggcaacgcggcgtttttcaccgccggacaaattatcgattttggcatcccattccggcaggcgcagcgcgtcggcggcgatttccaattcgtgttccgcaccgccgcccgtggacgaacctgccgcaataatcgcttccaagcggccctgctcttctgccaacgcgtcaaaatccgcatcaggattggcgtactcggcatacacttcttccaaacgtttctgcgcggcagccacttcgcccaaaccgctttccacttcctcgcgcacggttttttccggatcaagctcaggctcttgcggcaggtagccgattttgatgccgcccatcggcacggcttcgccctcaaattccttatccacgcccgccataatccgcagcacggtggacttgcccgcgccgttcaaaccgagcaggccgattttcgcgccggggaagaaagaaagggaaatatctttaatgatggttttctgcggcggcacaaccttgctcacgcgcagcatagaatagacgtattgttgggacatggttttctcgttttcatcaaacaaatttcagacggccattttaaccgataatttgatttaagccagtttatccgcgaaccggtattgccaaaatcgggcaggattcataaaatccgcttatccctttgaaattatatagacaaaaaaataataatgataggggatcgccgccccggcaaccatttcggattttccaaagcaaatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatctactatacttttcaaatcaaaaaaggatttaccttatgtcggaatatacgcctcaaacagcaaaacaaggtttgcccgcgctggcaaaaagcacgatttggatgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttgagcgatgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttagctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttgatttcagccggcccaagccgctggatgccgccgttgccgccctgcgccgcgaaacgggtcgggccggttttgacgacgcttaccgcgtgccgtccgatataggccgtcccgccgctgtgttgcaagccggacgccgccgtcgtatcagcatatacagcgaccgcaatggcttggtcatctttaccgccgccccgcaggatttcgcgcggcacgatgcgggcgtttacgacgcgctggcgaccgaggcgcagacgctgcccgacagcctgaattggcccgagttcggcaatattcgtctgaacaagggtgataccagggaggcgacgattgcttacggcatcgaatccctttcttaggagcttcctaacaccggttgcagacgacctttttatagtggattaacaaaaaccggtacggcgttgcctcggcttagctcaaagagaacgattctctaaggtgctgaagcaccaagtgaatcggttccgtactatttgtactgtctgcggcttcgtcgccttgtcctgatttttgttaatccactataagatttcaccattccctcaaatcaatccaaacaggagcttcataaatgtacacaagaatcatggaaatcagcccttggacgctgcgttcggcaaaactggaaaaagaacacaaacggctgcaagagagcctgaccagcttgggcaacggctatatgggtatgcgcggcagctttgaggaaacctattccgccgacagccacttaggcacctacatcgccggcgtgtggttccccgacaaaacccgcgtcggctggtggaaaaacggctatcccaaatatttcggcaaagccatcaacgcgttcaatttcagcaaagtcaaaatctttgtcgacgggcaggaagtggacttggcgaaaaacgacgttgctggcttctccgtcgaactcgatatgcagcacggcgtgttgcgccgctcgttcaccgtattcggtgtgcgtttcaatgtgtgcaaattcctgtctgtcgcacaaaaagagctggcggtcatccgctgggaagccgtatccgttgacggtaaaacccaccaagtccgcatcgattccatcatcgatgccgacgtgaaaaacgaagactccaactacgaagaaaaattctggcaggtattggacaaaggcgtttcagacagtctctcctacattgccgcccaaaccgtcgccaatcccttcggcgtggaacaattcatcgtcaacgccgagcaaacctttgccggcagcttcaaagccctcggcggcagccaaaccgactggcaggtctccaattcttttgaatccgaagtcggcagcacacccgaaacctttgaaaaacgcgtgattgttaccaccagccgcgattatcagagcttggaagcagtgaaagccgcaggccgcgccttgtcggaaaaaattgcaggcgttgcgtttgaaaccttgctggacgcgcacaaagcaggctggctgcaccgttgggaaatcgccgacgtggtcatcgaaggcagcgacgaagcgcagcagggcatccgcttcaacctgttccaactgttctccacctactacggcgaagacgcgcgactgaacatcggcccgaaaggctttaccggcgaaaaatacggcggcgcgacctattgggacaccgaagcctacgccgtaccgctctacctcgcactggccgaacccgaagttacccgcaacctgctgcaataccgccgcaaccaactgccgcaggcgcagcacaacgcgcgcgaacagggcttggcgggcgcactctatccgatggtaacgtttacgggcatcgagtgccacaacgaatgggaaatcaccttcgaggaaatccaccgcaacggcgcgattccttacgccatctacaactacaccaactacaccggcgacgagggctatcttgccaaagaaggcttggaagttttggtcgaagtgtcccgcttctgggcggaccgcgtccacttctccaaacgcaacggcaaatacatgattcacggcgtaaccggtccgaacgaatacgaaaacaacatcaacaacaactggtacaccaacaccctcgccgcatgggtattggactacacccgcgaagccttggcgaaatacccgcgtccggatttgaacgtgcgtgccgacgagttggaaaaatgggcggacatcagcgcgaatatgtaccgtccgcatgacgaagaactcggcgtattcgtgcagcacgacggcttcctcgacaaagacatccgccccgtgtccgcgctttcgcccgacgatttgccgctcaaccaaaaatggtcgtgggacaaaatcctgcgttcgccctttatcaaacaggcggacgtattgcaaggcatctacttcttcagcgaccgtttcaatatcgacgaaaaacgccgcaacttcgacttctacgaaccgatgaccgtgcatgaaagctcgctgtcgccctgtattcactctattctcgccgccgaactgggcaaagaagaaaaagccgtggaaatgtaccagcgcaccgcccgcctggacttggacaactacaacaacgacaccgaagacggcctgcacatcacctccatgaccggctcgtggctcgccatcgtccaaggtttcgcccaaatgaaaacctggggcggcaaactcagcttcgcaccgttcctgccgagtgcgtggacaggctacgccttccacatcaactaccgcggccgtctgattaaagtcgccgtcggcaaagaaaacgtcgtcttcactctgctcaaaggcgagtcgctcgatttgcaggtgtacggcaaagacatcacgctcgacggcagccacaccgttgcgttggaaaaataaggagggcgcaaaatgactttcactgcagtcctatttgacctcgacggcgtcatcaccgacaccgccgaataccactaccgcgcatggaaaaagctcgccgaagaactgggcatcagcattgaccgcaagtttaacgagcagctcaaaggcgtgtcgcgcgacgattcgctcaaacgcatcctcgcgcacggcggcaaaaccgtcagcgaagccgagttcgccgaactgacccgccgtaaaaacgacaactacgtcgagatgattcaggcagtcaaacccgaagacgtgtatcccggcattttgcccctgctggaagcattgagggcaaacggcaaaaaaatcgcccttgcgtccgccagtaaaaacggcccgttcctgctggaacgcatggggctgacccacttcttcgacgccattgccgaccctgccgccgtcgcacattccaaacccgcccccgacatcttcctcgcagcagccgagggcgtagatgcggacatccgccaatgcatcggcattgaagacgccgccgccggcgtcgccgccatcaaagccgccggcgccttgcccatcggcgtgggcaaagccgaagacttgggcagcgacatcgcgctggtctccggcaccgccgagctgacctacgcctacctgcaaagcgtgtgggaacagtcgggcaggtaaaacgcgtcagataaagtgtcaaggaagcaaaagaccgtctgaacagtgtttcagacggcctttttgcttttagaacagaatgataacccaacttacgcaaccctaaaaactaaatgccaatctcttaaccatgctattcaaatttatttgaacgattttttttctaaccagccaaccttaacaatcactattaaaatgcgcgccgatgttctgtctccgcctgtatgcggcttgggcgacggcgaggctgcattcgagcaggttgcggttttcgtattcggacgcggtgtgcggttcggcttggttttgcttccaaagctgcagttgggcgatggcgcggcgcaggccggtatcgttgcgtaggatgcctagatggcgttggttgaacgtttgcaggacggggcggctgaatgtgttttgaaggtcgtctgaaaagatgcctgcttcggcggagaggctttcagacggcctttggaatggttcggcttggaatgcttgtccgtctgcgatggcttgggcgcagagccttgcggtcacgacgcattcgagcagggagttgctggcaaggcggttggctccgtgcagcccagtgcaggcggtttcgcccaaggcgtagagctgcggcagggaggttctgccgcaggggtcggtttggatgccgccgcaggtgtagtgttgcacggggcggacggggatggcttggcgcgtgatgtctaggccgcattgggataaacagtgtcgatggatggatgggaaatgccggcggacgaacgctgcgggttgatggctgatgtcgagcgagacgaagtcttgcgtttgtttggcgatttcggctgcgatggcgcgggcaacgatgtcgcgcggtgcgagttcggcgcggcggtcgtaatgcggcataaatcgttcgcccgcttggttggtcaggatgccgccttcgccgcgcacggcttcggaaatgaggaaggtgcgtccgttttcagacggtcttgccaagcctgtggggtggaattggataaattcgaggtttccaactgcgcagcctgcgcgtatcgccatggcgatggcgtcgcccgtgcattcgggcggcgtggtggtggcggcgtaaatctgtcccaagccgccgcctgcgagtacggtatggcgggcgcggatgcggtaggtttcttgtgttcggcagtcgaggacggtcagtccgcacgccgcgcctgattcggtttgaatgtccaacgccatctgccgctcgcaaacgcggatgttcgggcggcggcgtatttgggcaatcaggctctgcatgacggcttcgcccgtgtagtcggcgacgtgggcgattcgtcggcaggtatgcccgccttcacgcgtcaggtgcaggccgttatgattccggtcgaacgccacgccctgcgccagcagccattcgattgccggtttgccctgcgacaggatggcgcggacggcggcttcatcacacaaacccgcgcccgcttccaaagtatcggcaacgtgtttttcgatgtcgtcctctcccgaccacgccgccgcaatcccgccttgcgcatgacggctggcggtgtcgtccagccggtttttgcacaaaataacgatgcggaacgattcaggcagcgacagggcgagcgtcagtgccgccagcccgtttccggcaatcaatacgtcgcaatcggtttgcatggtgttgtccttgtttgagaggccgtctgaaacggtatagtggattaatcaatgccccgacatatgcgacatggtattgagaagcaccacgcccagcaaaatcaaaccgatgctgacaatcccaatgaaatcagctttctcaccgaaaaacaccacgctgactaaagccgttaaaaccagtcccacgcctgcccaaatggcgtatgctgtagccagcggcatggttttcagtgtcatagacaaggcccaaaaacacaccgaaaagctgactaccacgccaatagaaggccacagtttgctaaacccgccactcagtttgagcatggaagaaccgcagacttcgcttaaaattgctacagtcagaaagagccagtgcatttgcatgtttttacctgataaatgaaagaaagtataattatatcaatgcaataaaataaaaaaacagtcttgttgttaaagattttttgtgtgcaaatcccgtcttgggaaagcaggcgggcggtattttcaggctgcacccattacgaacgacaaatcaggcggggcccatgccgttgaacacatcttttttcttcagccctgccgcaaagtcgagcatacgctgcaaaggcagtttggcggcttcgcccagcttcctgtccaacaggatttcgttacgtccgcttgtcagggcgtatttgatgccgcccagcgaattcatcgccatccacgggcagaacgcgcagcttttacagcttccaccgttgcccgccgtcggcgcggcgataaattgtttgtcgggcgcctgcttttgcatttcgtgcaggatgcccaaatcggtcgccacgatgaattttttttcaggacgcgatacggcggctttgagcagtttgctggtcgagccgaccacgtcgcccagttcgatgacgctttgcggcgattcaggatgaaccagcaccaccgcttcggggtgttccgccttcaacgccgccagctcttgccctttgaattcgttgtgaacgatgcacgaaccctgccacaacagcatatccgcgcccgtttcgcggcagatgtagtcgccgaggtggcggtcgggtccccaaatcagcttctcgccgcgtgatttcaaatacgatacgatttctaacgccaccgaagacgttaccacccaatcggcacgcgctttcacggcggcggaagtgttggcgtacaccaccaccgtgcggtcggggtgttggtcgcaaaacgctgaaaacgcttcttccgggcaacccaaatccaaagaacattccgcctccaaatcaggcatcagcaccgttttttcagggcagaggattttcgcgctctcgcccatgaagcgcacaccagccaccaccagcgtaccggcttcgtgttccgcaccgaagcgcgccatttccagcgaatcgcccacgcatccgcccgtctccaaagccaaatcctgaatcagcggatcaacgtaataatgcgccaccaagaccgcgtttttctccttcagcaaagccttgatttcgtctttcagacgatctgccgtctcgcggtcgggcgtgtcggcaaccttcgcccacgcctgacggatttggcaggcggaagtcggcgtttggatgagtggcatatcgtagtcgaacgagcggcgggcggcggtttgcatgatgtttccttgtagctgtttttcagacggcatgaaggtttgccgtctgtttttcaaactgtttttacattatgctcaacttgagtataatatgcaaggtcgtctgaaaacaggtttgcaataccgtaaaaccgacccgcttcgttccgacaaaccgctttggtttacaataaagcctttcccacccgcagaaagccgagcatggatgcctaccccgaagccgaagccccgccgcaaagcatcgtcgagctggttcccgtattgattgccgttaccgacggcggcctgcgggtattgaccgtcgcccaaggcatgctcctgcccaacggcccgctctcccccctgcgcaattccttgcaggcaggcgtaaaactgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgacagcatcctgcacccggatgcgaaatggcaggactgctacggctatttcccgtgggaagacttgcgcaccgacggcgggcagcgcgacgccgtcgtcggccgcctgcgcatttgggcaaactcggcggacacggaggaagtgcgccaaaagcggctcaagcgcattcatttgtgctggggggtcgaaccggaaaactggtcggaagaatacgttttgcaacgctatgaaatgctgtatgaaagcggcctgatagcggaagccgccgagccgcaggcaaacttcgacttcgcgcttacggggcagcccatgcgccacgaccaccgccgcgtactggcgaccgccctgtctcgcctgcgcgccaaaatcaaataccgccccgtgatttttgaactgatgccgcccgaattcacgctgctgcaactgcaaaacagcgtcgaagccatcagcggcagattgctgcacaagcaaaacttccgccgccagattcagcagcaaaacctcatcgagccgtcggataccggcgtatcgggcagcaaaggccgtcccgcgcagctttgccgcttccgcgacgacgtcctgcccgacaggctgatttcggacatcggactgccgctgggcagccgttagcccgttttcagacgacctatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgtaaaatgaagttttgccccatcggtgcaacatcaatctttttcaacaaaggaaaccccatgccgtctgaaaaaaccctctttcccctgcccgacaccctgttgcgccccatagtagaacaagccttgagcgaagacttgggcaggcgcggcgatattacgtccgccgccgtcatcgcccccgacaaaaccgccaaactcttccttgtcagccgcgaagacggcgttatcgccggcatggacttggcgcgtctcgcctttcagacgatggatccgtccgtccgcttccaagccgaaatccgagacgggcaagccgtccgcgcaggtcagacgcttgccgccgtcgaaggcaacgcccgcgcgctgctcgccgccgaacgcaccgcgctcaactacctcacgcacttaagcggcatcgccaccgccaccgcgcgtgccgttgccgaagtcgccgaatacggtacagacatcgtgtgcagccgcaaaaccatccccctgctgcgtgtcctgcaaaaatacgccgtcagggcaggcggcggtgtgaaccaccgcatgggtttggacgacgccgtgctcatcaaagacaaccacctcgcctattgcggcagcatcgcccaagccgtgcagcaggcaaaacaggctgtcggagcattgacctgcgtggaaatcgaagtggatacgttggcacaactggacgaagccatcgcagcgggcgcggaacggattttgctggataacatggacgacgaaaccctgaaagaagcggcaaaccgctgccacacgcaaaccgcccacccccacaccatctattgcgaagcatcgggcggcatcggcttcgaccgcctgaagcgcgtggcgcaaaccggagtggacggcatcgccctcggctatctgacccacagcagccgttcgttggacataggtttggatttcgtggcgtgagttttagggtgcgggcggctgtctgatatgtcaggcaaggaaccgcttaaccctaatccggttattgcctcagggaggaaatgccgtctgaaagattcttcagacggcatttttcgtaaaggtcgtgatgctttagaaaaaacagcatttcaggcaggtattttgtttgcccgacagcgcggcggcatcggtagggcaggaaaaaggacggggggcggcagttttatgccgtctgaaagcccgcctttacgcttgtttgcaaaaaaagtgggaaaaggaacatacaatcctgtacaatcatccataaatatttgatttataatacgatttataaagataatcacaatcatccatatctgccgcccgtcaatccgcttggcgggcggcaaaggttttaggaataccgatgaacacaataccgctccacaccatactcaaacttatggcgcatcccgaacgtatggcgatactgattcaattgttggacagcgaacgcaatatcgccgaactggcaaaatccttatccctgccggccaccgcagtttccaaccatttgaaccgcctgcgcgtggaaggtctagtcgattttacgcgttaccaccgcattatcgaataccgcctggtttccgaagaagcggcggcgattctgcacacggttcgcgatttggaaaacaaacgcgtggcatagtgttagaatcctttccttttgccgtctgaacgtttcagacagcatttttcggaaatgttatgaaaatcaccacttggaatgtcaattcgctcaatgtgcggctgccgcaggtgcaaaacctgcttgccgacaatccgcccgatattttggttttgcaggaactcaaactcgatcaggacaaatttccggccgccgctttgcaaatgatgggctggcactgtgtttggagcgggcagaaaacctacaacggcgtggcaatcgtcagccgcagcgtgccgcaggacgtgcatttcggtttgcccgcactgccggacgatccgcaacggcgcgtgattgcggcaaccgtcagcggcgtgcgcgtcatcaatgtctattgcgtcaacggcgaggctttggacagccccaaattcaaatataaggaacagtggtttgccgcactgacggagtttgtccgcgatgaaatgacccgccacggcaaactggtgttgctgggcgatttcaatatcgcgcctgccgatgcggactgttacgaccctgaaaaatggcacgaaaaaatccactgttcgtccgtcgaacggcagtggtttcaaaacctgctggatttgggactgaccgacagcctgcgccaagtccatcccgaaggcgcgttctatacctggttcgactatcgcggcgcgatgttccaacgcaaactgggcctgcgtatcgaccatattttggtgtcgcctgcgatggcggcggcgttgaaggatgtccgcgtcgatttggagacgcgcgcgctggagcgtccgagcgaccacgcgccggtgacggcagaattcgattggtaaaagaccgtgttttgatatggcgttgacaagcatccttatcttcaatttattcaataggatagctttctatctgactgaaaaataattgcctttccccggcaaacagccgaaatcggcggattgttcaaacacagcctattttcctgaaaaatttatgaaatacatagggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcagacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcccgacagataacacagatttttataagggtttttatttaaataaggattatatagaaggtatatatcctagtaggcataatggcagctattacaaaatatagtggattaaatttaaaccagtacagcgttgccgtactatttgtactgtctgcggcttcgtcgccttgtcctgatttttgttaatccactatatctgcatcagtttcatgaaacgcaagtcggaagcgtcaaacaactgattgcccattttgaccggctgattgacgaattggacaaacaaatcgacgaccacacccacacgcattttgacggcaaagcccaagtggcagaacaaatcaaaggcatcggttcgataacgacggctacgctgatggcgatgctgcccgaattgaggcggctgtcgcacaaacggatagcgggtttggccggcattgccccgcacccgagggagagcggggaaaccaaattcaaaagccgctgctttggcggaaggtctgcggtgcgtaaggcactgtatatggctaccgtggcagcgacacgttttgaaccgcttattcgggatttccaccaacgcccgctgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgctacggctcgatgaatcgtcagaaatacctgcatcgtcattcccgcgcaggtgggaatccagaccggtcggtgcggaaacttatcaggtaaaacggtttcttgagatttttcgtcttggattcccactttcgtgtgaatgacggaatgtaggttcgtgggaatgacgtggtgcaggtttccgtatggatggattcgtcattcccgcgcaggcgggaatctagtctgttcggtttcagttattttcgataaatgcctgttgcttttcatttctagattcccactttcgtgggaatgacgggattttaggtttctgattttggttttctgtccttgtgggaatgacgggatgtaggttcgtaggaatgacgtggtgcaggtttccgtgcggatggattcgtcattcctgcgcaggcgggaatccagtctgttcggtttcagttatttccgataaatgcctgttgcttttcatttctagattcccactttcgtgggaatgacggttcagttgctacggttactgtcaggtttcggttatgttggaatttcgggaaacttatgaatcgtcattcccgcgcaggcgggaatctggaatttcaatgcctcaagaatttatcggaaaaaacaaaacccttccgccgtcattcccacgaaagtgggaatctagaaatgaaaagcaacaggaatttatcggaaatgaccgaaactgaacggactggattcccgcttttgcgggaatgacggcgacagggttgctgttatagtggatgaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccattataaaaatgccgtctgaaaggttttcagacggcattggttcacgggccgcgcccgggtatttcggcaaaatcagtcggcgaccgccatcaggctggcgttgccgccggcggctgtggtgttgacgctgcaagagatttcttcaaacacttgcaggatgtcgagtccgttttccgaagggaggatgcggatgagtgcgccgtcgtgggcggcaagttcctgtttgcgcgcgctgtccaaaggcgacagggcggcaacgtggctgatgccggcggtttcgggtttgccgttgaccagcagcagaccttccaagtcggcagtgtaggaagccaaggggctgtcgggttcgaccactgcctgtatgccggaggcggcaagttcggtcagtgcggcaaaggcttgaaccgtgctgccgccgtgtatccaaacgcgtttgggcgcgtgccatgagatgctgttgcgctcgccggtcggtccggtaaggacggtttcggcacggcgcagggtgcggatgcgggcgtgtcccaaagcggccgctgcggcttttttctcttcggcgttgaacggtagtttgtgaaccagtgcttcgaggcgtttgagtgcggcttcgtccgcctgtccgatttggctcagggtcggggcaacccattcgccggcgcgggtcagtttttgcaggtagaacgaaccgcctgctttggggcctgtgccggacagaccgtgtccgccgaagggctgtacgccgacgactgcgccgacgatgttgcggttgacgtaaacgttgccggcttcgatgcggctgcggatgtggcgtaccgtgccttcgatgcggctgtgtacgccgtgggtcagggcgtagcctttgctgttgatttggtcgatgacgttgtcgagttcgtcggcgcggtagcggacgacgtgcaggacgggaccgaagacttcgcgttgcagttcgttgaggttgttcaattcaaacaggatggggcgaacgaacgtggattttttggaatcgacatcggcggcggttttgacttcgtggtaggacttggcaacacctttcattttgttgatgtggttcaacaggttttgctgtgcttcggcatcgatgacggggccgacatcggtagtgagctgaatcggtttgccgacgacgagttcgtccatagcgcctttgatcatgtcgagcatacggtcggcaacgtcttcttggacgcacaaaatgcgcagggcggagcagcgttgtcccgcgctgtcgaaggcggagttcaatacgtcggcgcagacttgctcggcaagtgcggtggaatcgacaatcatggcgttttgtccgccggtttcggcaatcaggacgggattgtcgccgcgtttggcaagggctttgttgatcaggcgcgccacttcggtcgagccggtgaaaatcacgccgccgatgcgggcatcgttggtcaatgccgcacccacgtcgcctgcgccgaggacgagttgcagggcggaagtcgggatgccggcttcgtgcatgagggaaacggcataaccggcaatcaggctggtttgttcggcgggtttggcgatgacggtgttgcctgccgccaatgcggaaacgacttcgccggtaaagatggcgagcgggaagttccacgggctgatggcgacaatcgcgccgacggcttttgcgtcttgaggcagggtatgttcggcttcgtttgcgtagtagcggcagaaatcgacggcttcgcgcacttcggcaatggcgttgttcagcgttttgcctgcttcgcgcacggcaagcatcatcagtgctggggtgtgctgctccagcaaatcggcaaaacggcgcaggcaggcggcgcgttcggcggcaggtgtcgcactccattcggggaacgcggcaacggctgcgccaaccgcttcttgggcaagcgcggcatcggcaaagctgactgtgccgacgatgtcgtcgtggtcggcagggtttttaatcggttgcgcttcgccgacatcgcgggctttgccgttgacgatggatgcggcgtggaagtcttgcgcggcggctttgttcatctgttcttgaagctgctgcaatacgttttcgttgctcaagtccacgccttgcgagttcagacggcatttgccgtacaaatcgcgcggcagcggcagggcgttgtgcaggtggatgccttgttcggcgatggtgtcgaacgggctgcggatgagcgtgtcgatgctgatgttttcatcgacgatttggttgacgaaagacgagttcgcgccgttttccaacaggcggcgcaccaagtaggcgagcagggtttcgtgtgtgccgactggggcgtacacgcgcacgcggcggcctaagttttgcgggccgacgacttggtcgtacagggtttcgcccataccgtgcaggcattggtgttcaaaatctttgcctttacccatttggtagattgcgcccaaagtgtaggcgttgtgggtggcaaattgcgggaataccgcgtcttgcgcggaaagcagtttgcgcgcgcaggcgaggtaggagatgtcggtgtggactttgcgggtgtaggtcggatagccgttcaagccgtccacttgcgcccatttgatttcgctgtcccaatacgcgcctttgacgaggcggatcattagtttttggttgttgcggcgggcaaggtcgatcaggtagtcgataacgaacggacaacgtttttggtaggcttggacaacgaaaccgatacctttgtagccagccaagtcagggtctgaaaccaaagcctccatcaaatccaaagacagctccagacggttggcttcttcggcatcgatgttgataccgatatcgtattttttacccaaaaggaacagctctttcaggcgcggcaacagttcgcccatcacgcggccgtgttgggtgcgcgagtagcgcggatggatggcggaaagtttgacggaaataccgttaccttcgtaaacgccttgtcctgccgcatctttgccgatggcgtggatggcttcgacatagtcgcggtagtagcggtcggcatcggcttgggtgtaggcggcttcgcccaacatatcgaaggagaagcggtagcccattttttcgcgttctttgccgttttgcagggcttcttcaatggtctgtccggttacgaactgtttgcccagaagccgcatggcgtaatttacgccttggcggatgagcggtgcgccgcctttgctgatcaggcggctgagtgcggaactcatttgtttgtcgtttgtggcggtcagtttgccggtaatcagcaggccccaggcggcagcattgacgaagagggaagggctgttgttcaaatggcttttccagttgccgtctgaaatcttgtcggcaatcaggcggtcgcgcgtggcgttgtcggggatacgcagcagggcttctgccagacacatcagcgcgatgccttcttcgctggagagtgaaaactcgtgcatcagcgcatccacgccgccggctttggtgcggccggcgcggacttgggtaaccaaacggcgggcaagctcggaggcggcgttgcgctcttcgtcgctcatctgtgcacgttgcaacatatcctgtacggcttcgatttcattacggcggtaggcatcggttatcgcttggcgcagggcagtttgtgccggaaatgcaaaatgaaacattttttggattctccaaagtttttcggggggcaggcggcatcggtgcggcctgaatacggtaatatcgtaataaatccgcagatgaaatacaaggcttcaaatgcgggcagggtaggtgcttccgtttctttgaaaatgaaacgggtaaaacacaaataaggcctgtatgcaggcaaggtttatttgtgtttgacccggaaacgggttcagacggcacgaaccgggatgccgtgccgtctgaaaggggtttatcgggtggcgcggtaatctgcgtcggctttttcaaagcgttcttgggtttcgcgcgaaggttctttgttgaacagggaaaccaacacggcaacgatcaagcaaacaataaagcccggcacgatttcgtacatcgtcaacaagccgctttctcctgccgcttgagccggttttttcacccattccgcccatacgactacggttaacgcacctgcaaccatacccgacaacgcgccgtaggcagtgatgcgtttccacaatacggacagaatcacaatcgggccgaatgccgcgccgaaacctgcccacgcgtaagacaccagtcccaatactttgctgttcggatcggaagcaatcaggatggaaatcacggcaatcgccaagaccatcaggcggccgacccataccaattccgactgttgcgcgtttttacgcaaaaagcctttgtagaagtcttcggtaatcgcgctggagcaaaccaaaagctggcaggacagggtggacatcaccgccgccaaaatcgcgctcaaaataatgccggcaatccaagggttgaacagcagggtggaaagcgcgatgaagatgcgttcgtggttgccgctcatagaagaaactttgtcgggatttgcaccgaaatacgcaatgccgaaataaccgaccgctaccgcgcccgcaaggcacaacgccatccaagtcataccgatgcggcgtgcggataccagcgatttcgcgctttcggccgccataaagcgcgccaaaatgtgcggctgtccgaaatagcccaagccccatgcggcggtggaaatgatgccgatgacggtcgtaccggcaaacaggctgccgtattctttgcccgtgcctgcggcgacactttgaatcgcggcagacatctgttccgcgccgcccaagcccagatagaccatcacaggcgttaaaatcagcgcgaaaatcatcaaagaagcctgcagcgtatccgtccagcttaccgccaaaaagccgcccaagaaggtataggcgatggtcgcgcccgcgcccagccacattgcctgattgtaagtcataccttcaaacaggctttggaacagggttgcgcccgccacaatgcccgaggcgcaataaatcgtgaagaaaaacaggataatcagtgcggaaaccactttcatcaagtgtccgcccgcgccaaagcggtggaagaaataatccggcagcgtcagcgcgttgttggcgtattcggtatgtacgcgcagacggcccgccaccaaaagccagttgaaatacgcgccgaccaagaggccgatggcaatccaagcctcattcaaaccgctcaaataaatcgcgcccggcagacccatcaaaagccagccggacatatcggacgcgcctgccgacatcgcggtaacaaacgggcctaggctgcgcccgcccaaaatataatcgtcgaaattgcgcgtagaaaaataggcggcaagcccgatgagaaggactgcaaccagatagattgcaaaagtaatgtacatgggattcatgtgctattcctcgtctaaaacttcagaattacaggctttgaaattgcaagcaacttgcgcctgaaatgtttttctaataaaagtacaacggaaaatccggatacccgaaagggggattcggataaattatcttcaatcacaataagatatgtaataaaactatatgaaattgtaaataatccgtttcaggataacccaatttctgttgtttgcaaagcacttaatggcttaaaaagccgagtttgaaacgatgcgcgtcggaaaaatcatttaaaacagcatattgttttgtagtgtcttgtaatcgggcgttgcgcggaatatgaaatccgttttcaggcggcaggtgttttgaggtgtaatttagcaaccgcaaaggaggcgcggtatgttttgccgattatccgccgcccgttttcagacggcatttttccttatacaatagccgattgaatttgatatgttcaggaaggatacagattatgttcggcaagcagctttttgaggaagtcggctcgaaaatcagcgaaaccatcgccaacagccctgccaaagatgtggaaaaaaatattaaggcgatgctgggcggcgcgttcaaccgtatggatctggttacgcgcgaagaattcgacatccagcagcaggttttaatcaaaacccgtaccaaactggcggctttggaagcgcgtttggaaaaactcgaagccgcgcaaaatcccgaacgggcagcattggaagcggctgaagccgctgccgaagaagccgtcgccgaaatcaggcagcaaaccgaagccggcgaataaggtcgtctgaaatatgtcgcttgccttggtttacagccgcgccttgagcggtatgaatgcgccgttggtcgaagtggaagcccaccttgccaacggcctgccacatttcaacatcgtcggactgcccgatatggaagtaaaggaaagtcgcgaccgtgtccgtgccgccattattcaaagcggttttgaattccccgccaaaaaaattaccgtcaacctcgcccccgccgacctgcccaaagagtcggggcgtttcgatttgccgattgcaatcggcatccttgccgcatcggggcaggttgcgcccgaaaaactggaggaatacgagtttgcgggggaattggcactgtcggggctgttgcgccccgtgcgtggcgcgttggcgatggcgtggcagggtatgcaggcaaaacgtgcatttgttttgcctgaagaaaatgcaggacaagccgccgtgatgcgcggcattaccgtttacggcgcgcgctctttgggcgaagtcgccgcccatttgaacggcatcgaacctttggcgcaaaccgaatgccaagttcctcagatgccgtttgaacatggcggacaacctgatttgtgcgatgtgaaaggtcagcacaccgcgcgccttgctttggaaatcgctgccgcaggcggacacagcctcttgatgatgggtccgccgggaacgggcaagtctatgctctcccaacggctgcccggcatcctgccgccgctgaccgaagacgaattggtagaagtttgggcattgcgttcgctcctgcccaaccaccaacaacaactcgacagcaaccgtcctttccgcagtccgcatcacagcgccagcgcggcggctatggtcggcggcggttcggatccgcgtccgggcgaaatttcattggcgcaccacggcgttttgtttttggacgagctgcccgagtttgaccgcaaagttttggaagttttgcgcgaaccgttggaaaacggcgaaatccacatttcccgcgcggcgcgccaagccgtctatcctgccaaattccaacttgttgccgccatgaacccctgcccgtgcggttatctcgggcatcccgtcaaaccctgccgctgcacgcccgaaagcgtcgcgcgttaccgcagcaagatttccgggccgctgctcgaccgcatcgatttgaccatcgaagtcccgagcctgtccgccgccgaactgatgcagcaggaagcaggggaaagcagcgcgtccgttttggaacgcgttatcgccgctagagacaaacaatacgcacggcaaggcaaagtgaatgccgccttgagtgtcagtgaactcgacacatccgcccgcattcaaaaagaagcgcaggaagcattgggcggcctgctggaaaaactctccctttccgcccgcagcttccaccgcattatgcgcgtggcgcgtacattggcggatttggcgggcgacgaagaagtcggcagaagccacgtcatgaaagccataggtttccgtcgtgctttataggaatgggaatggaagcaggttttgcccaaatatggcgatattgttagaatatccgcccgtaagcaaacggcgttaatgccgtctgaaacacattaaggtatgtttatgaacaaattttcccaatccggaaaaggtctgtccggttttttcttcggtttgatactggcgacggtcattattgccggtattttgttttatctgaaccagagcggtcaaaatgcgttcaaaatcccggcttcgtcgaagcagcctgcagaaacggaaatcctgaaaccgaaaaaccagcctaaggaagacatccaacctgaaccggccgatcaaaacgccttgtccgaaccggatgctgcgacagaggcagagcagtcggatgcggaaaaagctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataattatgaagctcaaacatctgttgccgctgctgctgtcggcagtgttgtccgcgcaggcatatgccctgacggaaggggaagactatcttgtgttggataaacccattcctcaagaacagtcgggtaaaattgaggttttggaatttttcggctatttctgcgtacattgccatcatttcgatcctttgttattgaaactgggcaaggcattgccgtctgatgcctatttgaggacggagcacgtggtctggcagcctgaaatgctcggtttggctaggatggcggctgccgtcaatttgtcgggtttgaaatatcaggcaaaccctgctgtgtttaaagcagtttacgaacaaaaaatccgcttggaaaacaggtcggttgccggaaaatgggctttgtctcaaaaaggctttgacggcaaaaaactgatgcgcgcctatgattcccccgaagctgccgccgccgcattaaaaatgcagaaactgacggaacaataccgcatcgacagcacgccgaccgttattgtcggcggaaaataccgcgttatcttcaataacggctttgacggcggcgttcatacgattaaagaattggttgccaaagtcagggaagaacgcaagcgtcagacccctgctgtacagaaatagccgaactcccgtatccgaaagaagcgcaagcaatggattttctgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcagttttggcggtagtgtttgaataccggcaacgtttcagcaatgtgttgcacggcttgggaaaagaccggaaagccaaccgcttcgtccttaatcttgccattgcttttatacctgccgccgtgatggggctgttgttcggcaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgccttgatgatcggcgttgcccaagtgtttgcactggttccgggtacgtcccgttcgggcagtacgattatgggcgggatgctttggggcatcgaacggaaaactgcgacagaattctcgtttttcttggctgtgccgatgatggttgccgcaacggcttatgatgtcctgaaacattaccgatttttcaccctgcatgatgtcggtttgattctgataggctttattgctgcctttgtttcaggcttggtagcggtaaaagcgttgctgaggtttgtttccaagaaaaattatattccttttgcctattaccgcattgtttttggtattgccatcattatattgtggctgtcaggctggataagttgggaatgaaaccataaacccgacctgaagacattattcgggtcgggtttgtctggcgggctgatatagtgaattaacaaaaatcaggacaaggcgacgaagccgcagatagtacggcaaggcgagccaacgctgtaccggtttaaatttaattcactataaaatcaggacaggcggggcgataggtttaaagtcgattgcctgttttgaaggcagtggtttattctttatttgctggcaatcaggcaataaaaaagcacatacctttttacggtctgtgcttttttatctggtggaggtaagcgggatcgaaccgctgacctcttgcatgccatgcaagcgctctaccaactgagctatacccccgaaaatttggtggcgaatcagggactcgaaccccggacacaaggattatgattcctctgctctaaccgactgagctaattcgccgtttcgtgaagacgctattatatgtttttctgtttttttgacaagccgtattttttaattttgaattagttgactgtttttaaatgttaaaaagtttatgccgtctgaagcggattcaggcggcatgagggttagagtttgtggcagatgtcgccgaagcggaatcctgcccagtcgatgccgatattttttccgaatgcgatgactttaaacagttcgcccatttcatgctggtcaatcagtttctgaacggcagcagcttcacagatgtaggctgccgaatccgttttccccgtctgtgccaatagctcggtaatgcccaagttcaataagaaatgggattggggaaggtaacctatcaaatctaatccggcatccgtccctgcttgtgcaatgtcggtaaagttgacatgtgcggtcaggtcggccaatccgatgaagtcaaaaggattgtggataatgtgatgtcggtagtgtccgatcagagtaccttgattgcgttgagggtggtaatactgcgctgcatcaaaaccgtagtcgatgaatatcatgcagccgtgttcgagtcttgaggcaagggtgcggataaaggcatattgttgcggatgtagttcgctggtatagggataatctgtttgaggaaaatagagggaagccaaggcagatagctgcaagtcgtgcagcggtcgtgccgaataggtaaaacggtcattatctaggcaaacgccgacatgctcgaatgagccgccttcatttttacggacgatttcgacaggcatggcatcgagtacttcgttgccgatgatgatgccgtcaaacgcttcgggaagtgcggtcaagtggacaactttttgagatgcttccggtgcgcgtgcttgaatcaggtttttctgacgtgctgccagctccggcgatatttcaataatatagtaacggctgatgccgtccgaaatgctgcccaacaaatcggcggcaagctgtccggttcccgcgccgaattcatagatattgcccgccgtttgggatagaagttcttgaagttggcgtgccagtgtctgtgcaaacagagaggtgagggtcggtgcggtaataaaatccccggtattgccgattttatggctgccgccggtgtagtagccgtattgcggagcgtataaaaccaattccataaaacgtgaaaatggaatccagttgccgtgtttgccgattttttcggcaatgagggtttgcagtttgagcgagaattgccgtgcttcgggagaggggaggggcatgataagtgttagcttgtgtaaatttattggatttcccgacatattacacgttggtacgggtgctgtcatggctttatcttaatactatatattgtgtttatattattaaattaatcatatatagttgtttattggttcgattattctgtaccgcacccgccgtgccgttgtcgtcattttttatcttattgtttttaaaaggaataaaaatttcagatatgttaatgagttttcatgccctgatttgaccgagtgtttaaaatttcttatagtgtcgattggtggggaattgtggggcaaagtgtctcttttacccttgtgattttgatttcggcttgggacatgtcatgttcggcggcgcacacgaattaagcatcgacagtaaggggcggttggctgttcctgccaaattccgtgacattctgtcgcgcctctatacgcctgccgtagtggtaacgctcgagtcgaaacacaagctgttgatgtaccctgttgcggagtgggaaaaggttgcggcgcaacttttaaacttaaaagtggcggataaccctgttttgcggcggtttcaaaatcttttgctgcataacgcggaaattttggaatgggacagcgccggccgggtgctggtttctgccggactgaggaagagggtggatttcgaccgtgaagtcgttttggtcggtcgtgccaaccgtttggagctttggggtcgcgagcagtgggaggctgagatggttcaggctttggatgacgatcctgacgaacttgccttccagttgagtcagacggatttgcaattgtgagtggagcagaaagttaccggcatatcacggtcttgctgaatgaggcggtggatgcgcttgccgtgcgcgaagacggtgtctatgtggacggtacgttcggcaggggagggcattcccggctgattttgtcgcgtttgggcgatgcggggcggttgattgttttcgacaaagacccgcaggcgattgctgtggcagaagagctggcgcgttcggacaaacgggtcggtgtcgtgcatggcggttttgcttcgtttcagacggcattggacggtttgggtatcggcaaggtggacggtgcgctgtttgatttggggatttcgtccccgcaaatcgatgacggcagccgcggtttcagcttccgtttcgatgcccctttggatatgcgtatggatacgacgcgcggtatgtctgccgcagagtggatagcggttgcgtcggaacaggatttgcacgaggtaatcaagaattatggtgaagagcggtttagccgccggattgcgcgcgccattgttgcgcaacgggcggaaagtccaatcgatacaacccgcaagctggcgcagatcgtggcacaaaacgtccgtactcgcgagcgggggcaggatcctgcgacgcgcaccttccaggcggtccgcatctttattaaccgcgagcttgaagaagtaggggcagtattgccgcaggtcatgtgtcgtctgaaagagggcggacgtttggcggtcattgctttccattcgttggaagatcgcattgtgaagcagtttgtcaaaaaatattcgcaacacgcgcccctgccgcgctgggcggcggtcagggaagcggatttgcccgagctgcccctgaaaatcgtgggcagggcattaaagccgggtgaggcggaaattgccgccaatccgagggcgagaagtgcggttttgcgtgtggcggagcggactgccggtccgataccggaacaatcacagagaaaaacgtctgaatggcaatgaacaaattgaatttccttctgctgcttgcggtgtgcgtttccgctttttccgttgtgatgcagcaaaaccagtacaggctcaatttcacagctttggataaggcgaaaaaacaggaaatcgccttggagcaggattatgcgcaaatgaggctgcaacaggcgcgtttggcgaaccacgaagcgatcagggcggcggcagaaaaacaaaacctccatccgccggtttcgggcaatacctttatggtggagcatcaaagatagaagcagcctgtgtgccggaatcggattcctgcgtcaggataataataacgagaagtaaaaatgttgattaagagcgaatataagcctcggatgctgcccaaagaagagcaggtcaaaaagccgatgaccagtaacggacggatcagcttcgtcctgatggcaatagcggtcttgtttgccggtctgattgctcgcggactgtatctgcagacggtaacgtataactttttgaaagaacagggcgacaaccggattgtgcggactcaaacattgccggctacacgcggtacggtttcggaccggaacggtgcggttttggcgttgagtgcgccgacggagtccctgtttgccgtgcctaaagagatgaaggaaatgccgtctgccgcacaattggaacgcctgtccgagcttgtcgatgtgccggttgatgttttgaggaacaagctcgaacagaaaggcaagtcgtttatctggattaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgcatggcgaagacggcgcggaagtcgttttgcgggaccggcagggcaatattgtggacagcttggactccccgcgcaataaagccccgaaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacaggcccggccgggcagacagcgaacagcggcgcaaccgtgccgtaaccgatatgatcgaacccggttcggcaatcaaaccgtttgtgattgcgaaggcattggatgcgggcaaaaccgatttgaacgaacggctgaatacgcagccttataaaatcggaccgtctcccgtgcgcgatacccatgtttacccctctttggatgtgcgcggcatcatgcagaaatcgtccaacgtcggcacaagcaaactgtctgcgcgtttcggtgccgaagaaatgtatgacttctatcatgagttgggcatcggtgtgcgtatgcactcgggctttccgggcgaaactgcaggtttgttgagaaattggcgcaggtggcggcctatcgaacaggcgacgatgtctttcggttacggcctgcaattgagcctgctgcaattggcgcgcgcctataccgcactgacgcacgacggcgttttactgccggtcagctttgaaaaacaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgcgaaaaccggcacggcgcgcaagttcgtcaacgggcgttatgccgacaacaaacacatcgctacctttatcggttttgcccccgccaaaaatccccgtgtgattgtggcggtaaccattgacgaaccgactgcccacggttattacggcggcgtagtggcagggccgcccttcaaaaaaattatgggcggcagcctgaacatcttgggcatttccccgaccaagccactgaccgccgcagccgtcaaaacaccgtcttaatccgagtatcaacgagattgttttatgttcagcaagttaacccctttggctgaaaccggcatcccgactctgtcgtgtgcaaacgcggcagggcgtttgttgcattcagacagccgccaaatcaaacaaggcgatattttcgttgcctgtccgggcgaatatgccgacggacgcagttatatccccgccgccgttgccaacggcgcggcttttgttttttgggacgacgacggcaaatttgcgtggaatcccgaatggaaagtccccaatcaaggcatcaaagatttgaaacaccgtgccggcatattggcggcgcaagtttacggcaacgtttcagacggcctcaaagtttggggcgtagccggaaccaacggcaaaacctccatcacacaatggctggcgcaagctgccgatttgttgggcgaaaaaaccgccattgtcggcacggtcggcaacggcttttggggtgcattggaagaaaccacgcataccacacccgcccccgtcgatgtccaaaccctgctctaccgtttccgtcaacaaggcgcaacagtcgccgcgatggaagtctccagccacgggcttgaccagtcgcgcgtcaacggcgtgtcattccgcagcgcaatctttaccaacctcacccgcgaccacctcgactaccacggcacgatggaagcctacggtgccatcaagtcgcgcctgttttactggcacggcttgaaacacgcagtcatcaacgtggatgacgaatacggcgcggaactcgtaggtcgtctgaaaaaagactgtcccgatttggccgtttacagctatggtttcagcgaacacgccgacatccgcattaccgactttaccgcctcttcagacggcatagcagccgtattccaaaccccgtggggcgaagggaaatgccgcacgcgcctgctcggacggttcaacgcgcaaaacctcgccgcctgcatcgccttgctgtgcgccaacggctatccgcttgataaggtattggatgtgctggcaaaaatccgtcccgcttcagggcgcatggactgcatcatgaacagcggcaagcccttggtcgttgtcgattatgcccacacgcccgacgcattggaaaaagcactcgccaccttgcaggaaatcaaaccgcagggtgcggctttatggtgcgtattcggttgcggcggcaaccgcgatcgcggcaaacgcccgctgatgggcgcggcagccgtacagggcgcggataaagtcgtcgtcaccagcgacaacccgcgtttggaaaatccgcacgacatcatcaacgacatcctgcctgccgttcccgcgcccgaatgcgtcgaagccgaccgtgccgccgccgtccgttatgcggttgaacaagccgccgcaaacgacatcatcctgattgccggcaaagggcatgaaaactatcaggatgtacaaggcgtgaagcaccgtttttccgatcttgaaatcgtcggacaggctttgttaactcgtaaataatgggatattcggacggcatcgtatgaaacaatccgcccgaataaaaaatatgaatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcgggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataaaaattatgttgtggttatcggtgagagcgcgcgttcggattatatgaatgtttacggtttcccattgcccgatacgccttttttgagtcagaccaaagggctgttgataaacggttaccaatcgaccgcccacgcgacgaatctttcgctgccgcagactttggggctgccgggagaaccgaacaataacatcgtcagcttggcgaagcaggcgggttttcggacggcgtggctgtctaatcaaggaatgttggggcattttgccaacgaaatttccacctatgccctacgcagcgattatccgtggtttacccaaaggggtgattatggcaaaagcgcggggttgagcgaccgccttttgttgccggcgttcaaacgggttttgataggaaatgcaggcacgaagcctcggctgattgtgatgcacctgatgggttcgcacagtgatttttgcacacgtttggataaggatgcgcggcggtttcagtatcaaactgaaaaaatatcctgctatgtttccaccatcgcgcaaaccgataaatttttagaagatacagttaagatattgaatgaaaataaagaaagctggtctttggtttacttttccgaccacggtttgatgcatgtcggtaaaggcggcgagcgaacgttgacacatggtgcgtggaagcgtcaaagctacggcgtgccgctggttaaaatttcgtccgatgacacgcggcgcgaaatgattaaagtgaggcgcagcgcgtttaattttttacgcggattcggcagttggacgggtatcgaaaccgacgagttgcccgatgacggctatgatttttgggggaatgttcccgatgtgcagggcgaaggcaataaccttgcctttatcgacggactgcccgacgaccccgcgccgtggtatgcgggaaaaggcaaatcgactaaaaatacgtctaaaaaatgatacgtacagaaaaaatgccgaatgagaatgggaaaataatctgtgttttaccacagcaaaacaggcgataaaaaaatcagccgctaccgatgtgtccgccgcccgaatattaacgaaagtaaatatgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcaaatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtgaaaatgaaaagccgacgtttttttaaagccttattgctgattgccgcgctggtcggcgcgttttatgccggaatgcggacgcaggcgtatctttatgaagatttatgtttagacttgggcggcggtaaaaatccggggagttacccaatttgcgtgattgagaaagtccctgcacgttaatctgcaaaagccgtccgaaaccttgccgggcggcaagccaacctcaaacgggcgcaggcccgatgtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataacgacaaaacaaaaaaaggaagccccatgtttttatggctcgcacatttcagcaactggttaaccggtctgaatatttttcaatacaccacattccgcgccgtcatggcggcgttgaccgccttagcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccagtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataaacctgcggcgacaatccgcccagccctatcgttaacggtggctgaaacccgccttatactaaaacagaagtaaaaccatgaaacagacagtcaaatggcttgccgccgccctgattgccttgggcttgaaccgagcggtgtgggcggatgacgtatcggattttcgggaaaacttgcaggcggcagcacagggaaatgcagcagcccaatacaatttgggcgcaatgtattacaaaggacgcggcgtgcgccgggatgatgctgaagcggtcagatggtatcggcaggcggcggaacaggggttagcccaagcccaatacaatttgggctggatgtatgccaacgggcgcggcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagacgcggcgtgcgccaagaccgcgcccttgcacaagaatggtttggcaaggcttgtcaaaacggagaccaagacggctgcgacaatgaccaacgcctgaaggcgggttattgaacagctcgcgatgccgtctgaaagcggcttgggcaggggcggacatctcctgctcaatatgatttgttttaggacaaaccaaaatgacttttcaaaacaaaaaaatcctcgtcgccggactcggcggtacgggtatttccatgattgcctacctgcgcaaaaacggcgcggaggttgctgcgtatgatgcggagctgaagccggaacgcgtgtcgcaaatcggtaagatgtttgacgggttggtgttttacacgggccgtctgaaagatgcgctggacaacggtttcgatattctggctctcagtcccggcatcagcgagcggcagccggatattgaggcgttcaagcaaaacggcggacgcgtgttgggcgacatcgaattgctggcggacattgtgaaccgccgggacgacaaggtaattgcgattaccggcagcaacggcaaaaccacggtaacgagcctggtcggctatctctgtatcaagtgcgggctggataccgttatcgcgggcaatatcggcacgccggttttggaggcggaatggcagcgcgaaggcaaaaaggcggacgtgtgggtgttggagctttccagcttccaactggaaaacaccgaaagcctgcgtccgactgcggcgacggtgctgaacatttccgaagaccatctcgaccgctacgacgacttgctcgactatgcgcataccaaagccaagattttccgtggcgacggcgtgcaggttttgaatgcggacgatgcgttctgccgcgcgatgaagcgtgccgggcgcgaggtaaaatggttttcgttggaacacgaagctgatttctggttggaacgcgagacaggccgcctgaaacaaggcaatgaagatttgattgtcacgcaagacattccgttgcaaggtctgcacaacgccgctaacgtcatggctgccgtggctttgtgtgaggccatcggtttgtcgcgcgaagcattgctcgaacacgtcaaaaccttccaaggcctgccgcaccgcgtggaaaaaatcggcgagaaaaacggcgtggtgtttatcgacgacagcaaaggcacgaatgtcggcgcgactgccgccgcgattgccggtttgcaaaatccgctcttcgtgattttgggcggcatgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtgatgccgtctgaaatgcaaacgccgtcattgttgggcggcaagtaaagatttagaataccgatttgggatgtatcgtatgttcggacggcattgtctgccgtctgaaatttttgccctttgcggcaggtgcaaacagactggcaggtggtttttttgaagatttcggaagtattggtaaaagtgggcgacggtgtccacactctgctgctcgacaggccgattgtgcgcgacggcaggaaattcgacgcgccgcttttgtggatggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttatcgggtggagtaaatcatgggcggtaaaacctttatgctgatggcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgaaagccgaatgcgtggaatttattaccgacatggtgtccgcctaccgcgatgccgatttggtgatttgccgtgccggcgcgctgacgattgccgagttgacggcggcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaaactgccgaaccatgccgtctgaaaagccgttcagacggcatggatgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttgaggcacacccgcctgacagacggaacatcatataaagatcgtctgaaaccgcaaatcaggtttcagacgacctctggcaacaagcataaagcaatcaggaaagaacaaaaacaatgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcgaagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatagtttagtaccgaaatccgctgccgttacgggcgtgggttttgccgatttatgtattgaaattttgaagaccgcacatgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatagtgggaacaggtatcggacagattacggccgtgccgtctgaaacggtgcgacgcaaatttcaatcagttttaagagcagacgaacaatggaacagcagcaaagatacatcagcgtactggatatcggtacgtctaaagtcctcgcactgatcggggaagttcaagatgacgacaaaatcaacatcgtcggtttggggcaggctccttcacggggcttgcgcgcgggcatggtaaccaatatcgatgccaccgtccaagccatcaggcaggcggtcaatgatgccgagctgatggcggataccaaaattactcacgttaccacaggtatcgcaggcaaccacatccgcagtctcaattcgcaaggtgtggttaaaattaaagatggggaagtcacgcaggcagacatcgatcgcgccattgaaacggcaaaggcaatcaatatcccgcccgatcaaaaaattctcgatgccgtggttcaagactacattattgacacccaacttggcgtgagggagcccatcggtatgagcggtgtgcgtctggatacgcgggtgcacatcattaccggtgcaagtacggcagtgcagaatgtccaaaaatgtatcgagcggtgcggtttgaaaagcgatcagatcatgcttcagccgttggcaagcgggcaggcggtgctgactgaagatgaaaaagacctcggcgtatgcgtcatcgacattggtggcggaacgaccgatattgccgtttatatgaacggtgccatccgccatacgtccgtcattccggccggtggtaatctgattaccaaagatttgtccaaatcgttgagaacacctctcgatgccgccgagtacattaaaatccattatggcgtggcatcatgcgatacggaaggcttgggtgagatgattgaagttccgggcgtgggtgaccggacatcgcgtcaggtttccagtaaggttctggcagcaatcatcagtgcacggattcaggagatttttggcgtagtgctgggcgagctgcaaaaatcgggtttccccaaagaagtgctgaatgcgggtatcgttctgaccggcggtgtgtccatgatgaccgggattgtggaatttgccgaaaaaatcttcgatttgcctgtacgcaccggtgcaccccaagaaatgggcggtttgtccgaccgcgtccgcacaccgcgtttttctaccgctatcgggctgcttcatgcagcatgcaagctggaaggaaacttgccgcagccggaaaacggtgcagtgcaagagagggaagggggcggcggtttgttggcaagattgaaacggtggattgaaaacagcttctgaacaggtggattgccgtttgacaggtgagaagtattttgccagcagcaagatacttcttatataatgaataataatttatttaaaccgtcctctgaatggggcgagcaggagtttttgaatggaatttgtttacgacgtggcagaatcggcagtcagccctgcggtgattaaagtaatcggcttgggcggcggcggttgcaatgcaatcaataacatggttgccaacaatgtgcgcggtgtggagtttatcagtgccaatacggatgcgcagtctctggcaaaaaaccatgcggcgaagagaatccagttgggtacgaatctgacacgcggtttgggcgcgggcgcgaatcccgatatcggccgtgcggcagcccaggaagaccgggaagccattgaagaagccattcgcggtgcgaatatgctgtttatcacgaccggtatgggcggcggtaccggtaccggttccgcgccggttgttgctgagattgccaagtctttgggcattctgaccgttgccgtggttacccgaccgttcgcatatgaaggtaagcgcgtccatgtcgcacaggcagggttggaacagttgaaagaacacgtcgattcgctgattatcatcccgaacgacaaactgatgactgcattgggtgaagacgtaacgatgcgcgaagccttccgtgccgccgacaatgtattgcgcgatgcggtcgcaggcatttccgaagtggtaacttgcccgagcgaaatcatcaacctcgactttgccgacgtgaaaaccgtgatgagcaaccgcggtatcgctatgatgggttcgggttatgcccaaggtatcgaccgtgcgcgtatggcgaccgaccaggccatttccagtccgctgctggacgatgtaaccttggacggagcgcgcggtgtgctggtcaatattacgactgctccgggttgcttgaaaatgtccgagttgtccgaagtcatgaaaatcgtcaaccaaagcgcgcatcccgatttggaatgcaaattcggtgcggctgaagacgagaccatgagcgaagatgccatccggattaccattatcgctaccggtctgaaagaaaaaggcgcggtcgattttgttccggcaagggaggtagaagcggttgctccgtccaaacaggagcaaagccacaatgtcgaaggtatgatccgcaccaatcgcggtatccgcacgatgaaccttaccgctgcggatttcgacaatcagtccgtacttgacgactttgaaatccctgcgattttgcgtcgtcaacacaattcagacaaataatgtgctgtttgcccgtaaacctgctgcctcccgaatcggtttgtccggtttgggaggtatgtttttcaagatgttgcaatttcgtacggtttgcggtcggcggattcagatttttccacttgatacagactttcagatatggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctgattgattcgatattaaaaatgccgtctgaaaggttttcagacggcattttgtttgccgatatatttaatttttattaaattatataaaaatcaaatacataataaaatacatcggattgcttaaaaataatacattgtttttatgtataaaatattttataagttttcaggattttgattatcaaaaatttttcttgatttcctgacaattttattgaaacaaataattcaaaattaatctagtttaatcatggaattaaaataaaatattaaaattatgtaatgagtctccttaaaaatgtttgacattttcagtcttgtgttttagattatcgaaaaataaaactacataacactacaaaggaacattactatgaaaccaattcagatgttttccccttttctgaataatccccttgttttcttcttgtctgcggttttgccgcataattccgaacggtctgctgtttttctttgattcgttttaaatatcaataagataatttttcccatatatttttaatgattggattgggatgcccgacgcgtcggatggctgtgttttgccgtccgaatgtgatggaagcctgtccatactgaaaaaaagtctataaaggagaaatatgatgagtcaacactctgccggagcacgtttccgccaagccgtgaaagaatcgaatccgcttgccgtcgccggttgcgtcaatgcttattttgcacgattggccacccaaagcggtttcaaagccatctatctgtccggcggcggcgtggcagcctgttcttgcggtatccctgatttgggcattaccacaatggaagatgtgctgatcgacgcacgacgcattacggacaacgtggatacgcctctgctggtggacatcgatgtgggttggggcggtgcattcaatattgcccgtaccattcgcaactttgaacgcgccggtgttgcagcggttcacatcgaagatcaggtagcgcaaaaacgctgcggccaccgtccgaacaaagccattgtatctaaagatgaaatggtcgaccgtatcaaagctgccgtagatgcgcgcgttgatgagaacttcgtgattatggcgcgtaccgatgcgctggcggtagaaggtttggatgccgctatcgaacgcgcccaagcttgtgtcgaagccggtgcggacatgattttccctgaagccatgaccgatttgaacatgtaccgccaatttgcagatgcggtgaaagtgcccgtgttggcgaacattaccgagtttggttccactccgctttatacccaaagcgagctggctgaaaacggcgtgtcgctggtgctgtatccgctgtcatcgttccgtgcagcaagcaaagccgctctgaatgtttacgaagcgattatgcgcgatggcactcaggcggcggtggtggacagtatgcaaacccgtgccgagctgtacgagcatctgaactatcatgccttcgagcaaaaactggataaattgtttcaaaaatgatttaccgctttcagactgcctttcaacaaatccgcatcggtcgtctgaaaacccgaaacccataaaaacacaaaggagaaataccatgactgaaactactcaaaccccgaccctcaaacctaaaaaatccgttgcgctttctggcgttgcggccggtaataccgctttgtgtaccgttggccgtaccggcaacgatttgagctatcgcggttacgacattctggatttggcacaaaaatgcgagtttgaagaagtcgcccacctgctgattcacggccatctgcccaacaaattcgagctggccgcttataaaaccaagctcaaatccatgcgcggcctgcctatccgtgtgattaaagttttggaaagcctgcctgcacatacccatccgatggacgtaatgcgtaccggcgtatccatgctgggctgcgttcatcctgaacgtgaaagccatccggaaagtgaagcgcgcgacatcgccgacaaactgatcgccagcctcggcagcatcctcttgtactggtatcaatattcgcacaacggcaaacgcattgaggttgaaagcgacgaagagaccatcggcggtcatttcctgcaactgttgcacggcaaacgcccaagcgaatcacacatcaaagccatgcacgtttcactgattctgtatgccgaacacgagttcaacgcttctacctttaccgcccgcgtgatcgccggtacaggctctgatatgtactccagcattaccggagcaatcggcgcgttgaaaggtccgaaacacggcggcgcgaacgaagtggcttacgatattcaaaaacgctaccgcaatgccgacgaagctgaagccgacatccgcgaacgcatcggccgcaaagaaatcgtgatcggtttcggtcatccggtgtacaccatttccgaccctcgcaacgttgtcattaaagaagtggcacgcggtttgagcaaagaaaccggcgatatgcgcctctttgacattgccgaacgtttggaaagcgtgatgtgggaagagaaaaaaatgttcccgaatctggactggttctctgccgtttcctaccaaaaattgggcgtaccgaccgctatgttcacaccgctgttcgtaatttcccgtacaaccggttggagcgcacacgttcttgagcaacgcaaagacggcaaaatcatccgtccgagcgcaaactacacaggccctgaagatttggcgtttgtggagattgaagaacgataattgaagaatgcaatagcagtttgttctttaatttcggtatgcaaagctaaggatttcagacgaccttgccttattggaaaggttgtctgaaataagtttaatctaataggagaagataatcctgtattggcgcaagtaacaggataagaaacatggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaaaccctttcagacgaccccttcaaaacgtcggctgaaacctcaaaccacaagaaaaacagatccacaggagaaccgacatggctgccaaccaacgttaccgcaaaccgctgcccggtacggatttggaatactacgacgcgcgtgcggcgtgtgaggacatcaagcccggctcttacgacaagctgccttacacgagccgcattttggcggagaatttggtcaaccgcgcggacaaagtcgatttgccgacgctgcaaagctggctggggcagttgatagaagggaagcaggaaatcgactttccgtggtatccggcgcgggtggtgtgccacgatattctggggcagaccgcgttggtggatttggcaggcctgcgcgatgcgattgccgaaaaaggcggcgatcctgccaaagtgaatccggtggtgcaaacccagctcatcgtcgaccactctctggcggtggagtgcggcggttacgatcctgatgccttccgcaaaaaccgcgaaatcgaagaccgccgtaacgaagaccgtttccacttcatcaactggacaaaaaccgcgtttgaaaatgtggacgtgattccggcgggcaacggcatcatgcaccaaatcaatctagaaaaaatgtcgcccgtcgtccaagtcaaaaacggcgtggctttccccgatacctgcgtcggtactgactcacatacgccgcacgtcgattcattgggcgtgatttccgtgggcgtgggcggattggaagcggaaaccgtaatgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttagaggtcgtctgaaaagcaagacgtagcgtgggtcgggttcaacattttgctcattcacgtaattctcgatatggcaggcatctactgtaaatcgtcattcccgcgcaggcgggaatccagaaagtggaattgaggaaaccttatttatccgatgagtttctgtgcggacaaatttggattcccgcctgcgcgggaatgacggggtttaataatctgccgtatcacaacacagtagccgtagattgtggcgaaccccgacagtttgcggaatcaaacggctttgtcggagtggcagcctaatgtacttctggaaagtgggtgtagcgtgggctttgcccgcgaaataaaggctgaattgacatggtatagaggattaacaaaaatcgggacaaggcggcgaagccgcagacagtacagatagtacggaaccgattcacttggtgcttgagcaccttagagaatcgttctctttgagctaaggcgaggcaacgctgtactggtttttgttaatccactataaatttaatccactatactgtaaatcgtcattcccgcgcaggcgggaatccagaaagtggaattgaggaaacctttttatccgatgagtttctgtgcggataaatctggattcccgcctgcgcgggaatgacggggtttaataatctgccgtatcacaacacagtagccgtagattggggcgaaccccgacagtttgcggaatcaaacggctttggtcggagtggcagcctaatccactataaaaatcgtgggcagagcccacgctacataaggagaatctagaaatgccgcaaattaaaattcccgccgtttactaccgtggcggtacatcaaaaggcgtgtttttcaaacgttccgacctgcccgaggcggcgcgggaagcgggaagcgcacgcgacaaaatcctcttgcgcgtactcggcagcccggatccctacggcaagcagatagacggtttgggcaacgccagctcgtccaccagcaaggcggtgattttggacaagtccgaacgcgccgatcacgatgtcgattaccttttcgggcaagtttccatcgacaaaccttttgtcgattggagcggcaactgcggcaacctcaccgctgccgtgggcgcattctccatcgaacagggcttggtcgataaaggcaagattccttcagacggcatctgcacggtcaaaatctggcagaaaaacatcggcaaaaccattattgcccatgtaccgatgcaaaacggcgcagttttggaaacaggcgattttgagctcgacggcgtaacgttcccggcagccgaagtacaaatcgaatttcttgatccagccgacggcgaaggcagtatgttcccaaccggcaatttggtcgatgaaattgatgtgccgaatataggccgtttgaaagccacgctcatcaacgcgggcattccgaccgttttcttgaatgccgccgacttgggctacacaggcaaagagttgcaagacgacatcaacaacgatgccgcggctttggaaaaattcgagaaaatccgcgcttacggtgcgctgaaaatgggtctgatcagcgacgtatccgaagctgccgctcgcgcgcacacgccgaaagtcgccttcgtcgcgcccgccgccgattacaccgcctccagtggcaaaaccgtgaacgccgccgacatcgatttgctggtacgcgccctgagcatgggcaaactgcaccacgcgatgatgggtaccgcctctgttgccattgcgaccgccgccgccgtacccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggtcatgagccgtagcgcacgcgtgatgatggaaggttgggtcagggtgcctgaggattgtttttaaattgacgtagcatgggtttgcccgcgagccataaaaaggtcgtctgaaaaacaagtaaacatcaaatcactgaccattcctttcccttgccctgtggcggaaggcggcaaatcacaaggaagaacacggaaaccccgataaaagacagcttcccgtattaccgtcattcccgcgcaggcgggaatccagacctgtcaatatggaggattggcaggggaaaacaggtttcgtgagttctacattctggattcccgccacagcctgtcctcgcgtaggcggggacggaataacgatagaaaatgcggcatacgctttgcccaaagaggccgtctgaaacaccttgcgcctgatgtctgcctttttcagacgaccccacaccaaaaaaacaaccacaaactacaaggagaaacatcatgtccgaccaactcatcctcgttctgaactgcggcagttcatcgctcaaaggcgccgttatcgaccgaaaaagcggcagcgtcgtcctaagctgcctcggcgaacgcctgaccacgcccgaagccgtcattacgttcaacaaagacggcaacaaacgccaagttcccctgagcggccgaaattgccacgccggcgcggtgggtatgcttttgaacgaactggaaaaacacggtctgcacgaccgcatcaaagccatcggccaccgcatcgcccacggcggcgaaaaatacagcgagtctgttttgatcgaccaggccgtaatggacgaactcaatgcctgcattccgcttgcgccgctgcacaaccccgccaacatcagcggcatccttgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcacgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacacgttgcggcgacatcgatccgggcgtatacagctatctgacttcccacgccgggatggatgttgcccaagtggatgaaatgctgaacaaaaaatcaggtttgctcggtatttccgaactttccaacgactgccgcaccctcgaaatcgccgccgacgaaggccacgaaggcgcgcgcctcgccctcgaagtcatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggttgtcccgaccaatgaagaactgatgattgcctgcgacactgccgaacttgccggcatcttgtagccaaaaaagggacgagtccgcaaaaatgccgtctgaaaccccaaacgcccgattaggctgatgaggattttagacggcattgttcatttttttgttatcttgcatttttgtgcggacggtggaatttcatcctgtaaacataaatatttgtcggaaaacagaaaccctccgccgccatttctacgaaagcaggaaaccagcaacgcaaagcgacagggatttgttggaaatgaccgaaaccgaacgaaccggattcccgcctgcgcgggaatgacgggattttctgtttttgtggaaatgacgggattttgaatttcgggcgtacaatacggaaaacatgacgataaggaaacaaaccatggcacagtttttcgctattcatcccgacaatccccaagaacgcctcatcaagcaggcggttgaaatcgtcaataaaggcggcgtggtcgtttatccgaccgattcctgttatgccttgggctgcaaactcggcgataaggcggcgatggaacgcatactctccatccgcaaaatcgatttgaaacaccacctgaccctgatgtgcgcagatttgagcgagttgggcacatacgccaaagtcgacaacgtacagtttcgtcagcttaaagccgccacacccgggccttatacttttattttacaggcgacgaaggatgtgccggcgcgcacgctgcacccgaaacgcaaaaccatcgggctgcgtattcccgataatgccattgcacaagccctgctgggggaattgggcgagccgcttttaagctgcaccctgatgctgcccgaagacggcgaaccattgaccgatccttatgaaatccgcgagcgtttggaacacgccgtcgatttggtgattgacggcggctggtgcggaaccgagccgaccaccgtcgtcgatatgaccgacggcacggaattggtgcgccaaggttgcggcgatacggcggtgttcggtttgtagggaaaccgatgccgtctgaagcatcggctgttcagacggcattgcgcgccttgccggcggcagtccgaaatgccggcgcgtatcgcgctcggtcggaatatccgtttgaaacggcattttgatgcattactgcaccgcaatcggaattctcggttcgtagagcaggtcgtaggtcggcttgttgagcaggtcttggagcgtgaaaccgtccagatacgtgaaaaacgacttcatcgcgccgccgagtatgcccgtcagccggcaggacggtgtaatcaggcattcgttgttctcgcccatgcactcgaccagctgcatcggttcgaggtggcggacaaccgagccgatgttgatgcggtcgggcggtgcggcaagccgcagaccgccgccttttccgcgcacactgtggaggaagccgcctttgaccagcgcggtaacgaccttcatcagatggcttttggaaatgccgtaggttacggcgatggtactgatgttgaccagcgcatcgtcgttgatggcagtgtagataaggacgcgcagcccgtagtccgtatgttgtgtcaaatacatgattttctcggtatggattgttattcttatcggtacggtttaaggttcacggacaataccttaatggttgaaaccctgtccgtcggggcggtagaatgcagcctgtctgcggcggtatgccgtctgaaacatccgcgctaccgtttgagaatttgttattgtaactcaaaatcatgaaaccgttgaaacgacatcccgcccttatcgggctttcgcgtgaccaccaccattcgctttccctgtgcgtgcgtctgttgcggacgccggaagaaaggcatcgggacgaactcgaaccgcatttttccgaattggaaacccattttcgcgaagaagaaaccaagtttgccccaatttggcagaatgtcgcccccgaattgaaacaacgtttcgagaaagaccacgcccgactgcggcagatgatggcaagccccgaatacggtaacgcggcgtggaataccgcttttgccacaaccctgcgcgaccacgcgcgctttgaagaacgcgagctgtttcccgccgccgaaccgtttttgccggcatgattccgttttgcggtaaatatattaatgataaacaaggaacacacatgaaatttaccaagcaccccgtctgggcaatggcgttccgcccattttattcgctggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatggtgtcgggttttatcggtctgattggtacgcggattatttcgttttttacgtccaaacgcttgaatgtgccgcagattcccagtccgaaatgggtggcgcaggcttcgctgtggctgcccatgctgactgccatgctgatggcgcacggtgtgttggcttggctgtctgccgtttttgcctttgcggcaggtgtgatttttaccgtgcaggtgtaccgctggtggtataaacccgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgcttggtcatacgggcaatccgatttatccgccgcccaaagccgttcccgttgcgttttggctgatgatggcggcaaccgccgtccgtatggttgccgtattttcttccggcactgcctacacgcacagcatccgcacctcttcggttttgtttgcactcgcgcttttggtgtatgcgtggaagtatattccttggctgattcgtccgcgttcggacggcaggcccggttgagacaaaccgccgcagatttcgggtctgggcggtttgcttttcagacggcagggcggtcagttgccgtccagccagcggtcgcgtgtggttttggcttcttcaaaatagcggtacagggcttcgcggtcgtcggtggtcaggatgtttgccaaaacgtccaactgtttgcccaagccttgaaccagttgcagcaggctgtctttgttggcaaggcagatgtccgcccacacggcgggatgaccggaggcgatgcgggtgaagtcccgaaagcccgtggcggcgaatttcagatattcctgtccgtcggggtggtcgagaatctggtggacataggcgaaggcggtcaggtggggcatatgggagacggcggcgaaaaccgcgtcgtggcgttgcgcgtccatcgtataaatttccgcaccgaccgcgtgccacaggttttctaccaaggcaatgccgtctgaatgttcgccgccgtgtggcgtgatgatgagttttctgtggcggaacagcccgaactgcgcggcttgcgcaccgcttctgtccgaaccggcaattgggtgggcggcgatgcagtggtgcaggcggtcgggcagacagcggcggaaggcttcgatgaccgaagatttggtgctgccgacatcggaaatccaagtgtgttccggcaaaacggggcgcagcgcggtcaaaatggcgggaacggtggcgacgggcgtggcaatcagtaccaagtccgcaccgccgatgctgtccgcgtcgatggcaacggaagcctggtcaatcacgccgcgttccaatgcacgttcgaggttgtcgcggtcggtgtcgataccggtaacggtgcggacgagtccctgccttttgaggtcgagaacgaacgaaccgccgatcagccctacaccgatgagggcaatatggttcaaaatgggcatttgtgtaaacggttttcgcaaagtaccgtcatggtagcctatcggcggaatatgccgcaaggtcggcaggaaaaaggagaagaaatggacaaaatcagagttgccgccgtgcagatggtgtcgggcgtgtcgccggaaaccaacgtcgccgccatgaaacgcctggtcgcacgggcggcggagcagggtgcggattgggtgctgctgcccgaatattgggtgctgatgggcgcaaacgataccgacaaactcgcgcttgccgagcctttgggcggcggacgctttcagacggcattgagcgaaacggcgaaagaatgcggcgtggtgctgttcggcgggactgtgccgctgcaaagctgcgaggcgggtaaagtgatgaatacgctgttggtgtacggacgggacggcgtaaggacggggctgtaccacaaaatgcacctcttcggtttttccggtttgggcgaacgctatgccgaagccgataccatccgcgcgggcggggatgtgccgcacttgtcggcagaaggcgtgccggtggcggcgggcatttgttacgatgtccgctttcccgaatttttccgacgccagttgccgtttgacgtattgatgctgcccgctgcgtttacgcacacgacgggcaaggcgcattgggagctgctgctgcgcgcgcgtgccgtcgaaaaccaatgttacgtcgtggcggcggcacagggcggtttgcacgaaaacggacggcgcacgttcggacacagcatgattgtcgatccgtggggcgacgtgttggacgtattgcccgagggcgaaggcgttgttacggcagacatcgatgccaaccgcctgaacagcgtccgcaaccgcctgcccgccttgaaataccgggttttggatgccgtctgaaggttcagacggcatcggtgccggggaatcagaagcggtagcgcatgcccaatgagacttcgtgggttttgaagcgggtgttttccaagcgtccccagttgtggtaacggtatccggtgtccaaggtcagcttgggcgtgatgtcgaaaccgacaccggcgatgacaccaagacccacgctgctgatgctgtggctttcgtgatagggaggtttgctgggatcagtttgtataatagggcctccctgtggagagccgttctttggtttagaggtaatagtcgtggtttttgtttccaccgaatgaacttgatgtttaacgtgtccgtaggcgacgcgcgcgccgatatagggtttgaatttatcgttgagtttgaaatcgtaaatggcggacaagccgagagaagaaacggcgtggaagctgccgtttccctgatgttttgtttgggtttctttgtagttgttgtttatctcttcagtaacttttttagtagaagaattactttctttccattttctgtaactggcataatctgccgctattctccagccgccgaaatcatagccgaccgacacccgggggtggatggaatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaaggttttttgggggctggattcattttcgactccgtattcggttttaactgattaaaaagaaagattttcactgatgttgcaggggtggattgtatcgggtttggggcgatgtttcaacacaatatagcggatgaacaaaaaagagaacgatgctctaaggtgcccaagcaccaagtgaatcggttccgtactatagtggattaacaaaaaccagtacagcgttgcctcgccttagctcaaagagaacgattctctaaggtgctgaagcaccgagtgaatcggttccgtactatttgtactgtctgcggcttcgtcgccttgtcctgatttttgttaatccgctataaagaccgtcgggcatctgcagccgtcattcccgcgcaggcgggaatctagaccttagaacaacagcaatattcaaagattatctgaaagtctgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtccttgtgggaatgacgggatgtaggttcgtaggaatgacgtggtgcaggtttccgtgcggatggattcgtcattcccgcgcaggcgggaatctagaccttagaacaacagcaatattcaaagattggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgtccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagattatctgaaagtctgagattctagattcccactttcgtgggaatgacgggattttaggtttctgattttggttttctgtccttgtgggaatgacgggatgtaggttcgtaggaatgacgtggtgcaggtttccgtgcggatggattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcgccttagctcaaagagaacgattctctaaggtgctgaagcaccaagtgaatcggttctgtactatttgtactgtctgcggcttcgtcgccttgtcctgatttttgttcatccgctatacttttgtatgaccatctgactttatcactcactatgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgcggctggtacgcctattggctgtggaacaaggggatgagccgtgttcctgccaatgtttcgggactgttgatttcgctcgaacccgtcgtcggcgtgctgctggcggttttgattttgggcgaacacctgtcgcccgtgtccgccttgggcgtgtttgtcgtcatcgccgccaccttggttgccggccggctgtcgcatcaaaaataaagttgggaagcggtatttgatgattgccgaataggctgaaatctttccatctccattcctgcgaaagcgggtatccggaacgaaaagacggatatttatccgaaataacgaccatctttgcgtcgtcattcccgcgcaggcgggcatccggttttttgagtttcggttatttccgacaaattgctgcagcgttggatgtccggatttccgcctgcgcgggaatgacgggattttatagtggattaacaaaaatcaggacaaggcggcgagccgcagacagtacagatagtacggaaccgattcacttggtgcttcagcaccttagagaatcgttctctttgagctaaggcaaggcaacgctgtactggtttttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcaatcgctgaacgcggatgttcaccgcatcgaacagagtttgagtttgtttatgttcggcacggcgttcggacaggtggtcggcggttcggtgtccgacatcaaagggcgcaaacccgtcgccctgaccggtttgattgtatattgccttgccgttgccgccatcgtatttgtttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggacgggacgtgttcgggctggtggcggggcggttcaagcgcgtattgaaaacccgtgctgcgatgggttatctgttttttcaggcattcagcttcggttcgatgttcgcctttctgaccgaatcttccttcgtgtaccagcagctctaccgtgttacgcctcatcaatacgcttgggcgtttgcactcaacatcatcacgatgatgtttttcaaccgcgttaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaacgatgaccgcgtccacctcttgcggcattgcgcttctgtggctctgctcgcatcgtgcgtggaaagaaaacgggcaaagcgaatacctttaacggaaaatgccgtctgaaaccgtttcagacggcatttgatgttagaatgcacgataaattactgttcaggcgaaattatgtcccaaactatcgacgaactcctccttccccaccgcaacgccatcgacaccatcgatgccgaaatcctgcgcctgctcaacgaacgtgcgcaacacgcccacgccatcggcgagctgaaaggcacgggcgcagtgtaccgccccgaacgcgaagtcgccgtgttgcgccgcattcaggatttgaacaaaggcccgctgcccgacgaatcggtagcacgcctgtttcgggaagtgatgagcgagtgcctcgccgtcgaacgcccgctgaccatcgcctatctggggccgcagggcacgtttacccagcaggcggcaatcaaacatttcggacacgccgcgcacaccatggcgtgtccgaccatagacgactgcttcaagcaggttgaaacgcgtcaggcggattatctggtcgcccccgtggaaaattcgaccgaaggctcggtcggtcgcacgttagacctgcttgccgttaccgcgttgcaggcgtgcggcgaaatcgttttgcgcatccaccacaaccttttgcgtaaaaacaacggcagcaccgaaggcattgccaaagtcttttcccacgcgcaggcgttggcgcagtgcaacgactggttgggcagacacctgcccaacgccgaacggattgccgtgtccagcaatgccgaagccgcaaggctggttgccgaatcggacgacggtacggttgccgccatcgccggacgcacggcggcggaaatctacggactcgatatggttgccgagtgcatcgaagacgaaccgaacaacaccacgcgcttcttggtgatgggacatcacgaaaccggtgcaagcggcagcgacaagacttcgctggccgtttccgcgcccaaccgggcaggcgcggttgcctcgctgctgcaaccgctgaccgaatcgggtatttccatgaccaagtttgagagccgtccgagcaaatccgttttgtgggaatacctgttcttcatcgacatcgaaggacaccgccgggacgcgcagattcagacggcattggaacgcttgggcgaacgcgcttcgttcgtcaaagtcatcggttcgtacccgaccgccgttttgtagcggcggcagcgttcagacggcatttccccaacgattatgtccgaataccgagtcaaccatgaacccgtttttatgctggcatcttcgccctggcgcgaaagcagcctgtgggttgaagcattcagccgccgttacgggcgtgtggctttgctggcgcgcagcgcgcgcaaaaggcagagcgagctgcgcggcgtattggtgccgttcgtgcccgtcagcgtgtcgtggtacggcagtcaggaactcaaaaccctacaccgcgccgaatgggtcggcggttggcggcagcctcagggcagggcgttgttcggcggattgtatgtgaacgagttggtgttgaaactgaccgcccgcgaagacccggtgcccgagttatacgacgcgttggcggaagtgatggaggcggtgtgctgcaaagccgcttatatcgacgacttgcgccgtttcgagtggcggctgctgaacctgttgggcgttgcccccgatttgaaccgcgacggggacggcgggacgattgcggcaggcggcacataccttgtccgcccggaaacagccgtcttccccgtcggaaaaggatttgccgtaccgccgcacgccgccggcgttgtcgcccccgggcagagcctgatcgatttgcgcgaaggcagtttccgcactgccgaaagcctgcaacaggcattgaaaatcacacggctttttatccgccacctgttgcccgaggggctgaaatcgcggcaggtgttggaacagatacggcagtttgaccgcaaagaaaccgcccgggaaaccgtcccgacttcggacggcacggcttcaaatgccgtctgaaggcagaaataaaaggaaagattatgcttttaggtgtcaacatcgaccacatcgccaccgtccgcaatgcgcgcggtacgacttatcccagccccgtggaggcggcactggttgccgaaacgcacggtgcggatttgattaccatgcacctgcgcgaagaccgccgccacatcaaagacgcggacgtgtttgccgtcaaaaacgccatccgcacgcgcctgaaccttgaaatggcgttgacggaagaaatgttggaaaacgctttgaaagtgatgccggaagacgtgtgcatcgtgcctgaaaaacgtcaggaaatcacgaccgaaggcggtttggacgtattggcgcaacaggaaaaaatcgccgggttcaccaaaatcctgaccgacgcaggcatacgcgtgtctttgtttatcgatgccgacgacaggcaaatccaagccgcccgtgatgtcggcgcgcccgttgtcgagctgcacacaggcgcgtatgccgacgcgcgcagccacgccgaacaaatcaggcagttcgagcgcatccaaaacggcgcgcatttcgccggcgatttgggcttggtcgtcaacgccggacacggactgaccatacacaacgttacccccatcgcccaaatcctcgccatccgcgaactgaacatcgggcattcgctgattgcccaagccctcttcctcggactgcccgaagccgtgcgccaaatgaaggaggcgatgttcagggcaaggctgctgccgtaagggcaggcaaaccctttcagacagcatttcacgacagggatatgttatagtggattaaatttaaatcaggacaaggcggcgaagccgcagacagtacaaatagtacggcaaggcaagccaacgccgtactggtttaaatttaattcactatatgaatcaaaagtatattttatctgcaaacaataatagtttgatagaagaaattcacaatacagtacagagtattgggtattgtattgttcgaggtcttaatctaaaccatcttgatggcagccggagaaacaagaaattatttgactttctatctcaattaggaatgctgacaaaccacaaaggcgatggttttaaatctatattttgggatattaaatattgaggcgatgattatgtaatatagtggattaacaaaaatcaggacaaggcgacgaagctgcagacagtacagatagtacggaaccgattcacttggtgcttcagcaccttagagaatcgttctctttgagctaaggcgaggcaacgccgtactggtttttgttaatccactataaataatgatataactttctcggaagatgttggagaatgtccacttcatagtgattcatcttttagtgaaaacccggaaagttatttggttatgtatgtagtaaaatcagccaatgatggaggtaattccctatttttaagttcatcagatattgtcaatcagttatctaaaacagaaaccggtaaaaaacacttaaaaacattaacgggcaatttatatccatttaaaacaccagcatcatttgataaaaaacaaggtgtgagatggggtaatatcttatcggtcaatactcaaatgattagatttagaagtgattgtatctataaaggtattgaagaaaatagaaataaagtatcaaaggaaatggtacttgcacttgattatcttataaatgttataaaaaatgcgagtgatattcaagaattttctgcacaagatgatggtttgattattattgacaatgtcaatggcttgcatgccagaactgattatacggataaaaacaggcattatattagagcaagaattactgtataaaggacggttatgcaagaaataatgcaatctatcgtttttgttgctgccgcaatactgcacggaattacaggcatgggatttccgatgctcggtacaaccgcattggcttttatcatgccattgtctaaggttgttgccttggtggcattaccaagcctgttaatgagcttgttggttctatgcagcaataacaaaaagggtttttggcaagagattgtttattatttaaaaacctataaattgcttgctatcggcagcgtcgttggcagcattttgggggtgaagttgcttttgatacttccagtgtcttggctgcttttactgatggcaatcattacattgtattattctgtcaatggtattttaaatgtatgtgcaaaagcaaaaaatattcaagtagttgccaataataagaatatggttctttttgggtttttggcaggcatcatcggcggttcaaccaatgccatgtctcccatattgttaatatttttgcttagcgaaacagaaaataaaaatcgtatcgtaaaatcaagcaatctatgctatcttttggcgaaaattgttcaaatatatatgctaagagaccagtattggttattaaataagagtgaatacggtttaatatttttactgtccgtattgtctgttattggattgtatgttggaattcggttaaggactaagattagcccaaatttttttaaaatgttaatttttattgttttattggtattggctctgaaaatcgggcattcgggtttaatcaaactttaattcattattaaatgccttaactccttattaaataattggcacgatgttttagaatttcaaatgcaaaaggttacagtgaaaattgttaccgacaaaaccccaaaagtggatattcacgccattttaacgccccaagaaattgacggcattcatcatcacattcatcactacccgcaaccaagggcgaaggagcgcaaatatgatttacggcatcggcacagacattgtttccctcaagcgcatcatccgcttaaacaaaaaattcggacaggcgtttgccgggcgcatcctcactccggaagagctgcttgaatttccgcaagcgggcaaacccgtcaactacctcgccaaacgctttgccgccaaagaagcctttgccaaagccgtcggcacgggcatacgcggcgcggtttccttccgcaacatcggcatcgggcatgacgcattgggcaagcccgaatttttctacggccccgccctgtccaaatggctggaggaacaaggcatcagccgcgtcagcctcagcatgagcgacgaagaagacaccgtattggcgtttgtcgttgccgaaaaataatgccgtctgaaatgcggcaaacccgttgacggcattgcccgtccctcatttgcactccgaccgaccaaccgcgtacccgccatgattcaagacacccgaccccttatccgcgtcgttgccggcatcctgctcgattcagacggcaactacctgctcagctcgcgccccgaaggcaaaccctatgccggatattgggaatttgccggcggcaaggtcgaagcgggcgaaaccgacttccaagccctgcaacgcgagtttgaagaagaactcggcatccgcatcctcgccgccacgccttggttgaccaaaatccattcctacgaacacgcccgcgtctgcctgaaattcctatgggtcaaccccgaccaatggacgggcaaaccgcaatcccgcgaagggcaggaatggtcttggcagaaggcgggtgattttaccgttgcccccatgctgcccgccaacggcgcgcttttgcgttcgctgtccgtcccgcgccgtttgtacggcagcctgaaaacgggtttgcacggagaaaacagtatgggcgcgtaccgcgtcctgcctttgggttcggcagagggaagcggtgcgaacgttttgatggaggcggcgcaatggcaggacagacccgaacacgccgacagcgtgtggatggtggtgcagacccgcgaacaatggcggcgggcgcaggaaaagggcgcggatgcggtcgtttggcgcgtgtgcgatgatgttcaggcacaagaggcggcagaagccctgcggcagggcgtatccgtgccgctcgtacttgcagcaaacggacagacggttgcacgttatggaaaactatggctcggattgggggcgcacgtggtggtaagggatgaaacaatagggaagaatcatgaataaaaaccgtaaattactgcttgccgcactgctgctgattgcctttgccgccgtcaagctcgttttgttgcaatggtggcaggcgcagcagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagtcggacatttcagacggcatttaccgccgaataaacctttcaatccgccattgccggaacatccgtccggaaaggacacgttatgaatactttatatacacttttcgccacctgcccgcgcggcttggagaccgttttatctcaagaactcgaaagcctcggctgtaccgatgtacaagtgtttgacggcggcgtttcctgccggggcggattggaacaggtttacgccgccaacctgcattcgcgtactgccagccgtatcctgctgcgcctgaccaaagggacataccgcaatgagcgcgacatctacaaactcgccaaaaatatcaactggtttaattggtttactttacagcagacgttcaaagtcaaagtcgaggcaaagcgtgccaacgttaagagcatccaatttgtcggactgaccgtcaaagatgccgtctgcgacgctttccgcgacatttacgacgcacgtccgagcgtggacaaagccgcgcccgatgtccgcatccacgcctttttgaacgaacgcaatgtcgaaatctttattgacacttcgggcgaagccctgttcaaacgcggctaccgcctggataccggcgaagccccgctgcgcgaaaaccttgccgccggactgctgctctcggcaggctacgacggcacgcagccgtttcaagacccgttttgcggcagcggcacgattgctatcgaagccgcttggattgccgcccgccgcgcgccgggtatgatgcgccgtttcggttttgaaaaactgcaaaatttcgataaaacgctgtggtcggatttgcggcgccgcgccgaagcgcaaacccgccccgtccgcgccccgattgcaggcagcgacaacgaccgccgcatcgttcagacggcattggacaacgcacgccgcgccggggtggacgacatcgtttccttcagcgttgccgacgcgcagtccgtccgaccgaacggcgaaaacggcattatggtgtccaatccgccctacggcgtgcgccttgaggaagtccgcgccttgcaggcactgtatccgcagttggggacgtggttgaaaaaacattacgcaggctggttggcggcaatgtttaccggcgatagggaaatgcccaaattcatgtgcctgtcgcccaagcggaaaatcccgctttataacggcaacatcgactgccgcctgttcctgattgatatggtggaaggatcgaaccgttgaggaaagtgtacaaaaatgccgtctgaaaaatgttcagacggcatttatttttcggaatcaaccccgcttcaatacggatgtattgatgtagcgttggacacccgaggcaatggattgggcgcactgccggcggaaggattcgctgcccagcagcttctcttcggcaggattggacaggaaggcggtttcgaccaggatagacggcatatcgggtgcgcgcaaaacggcgaaattggcttcgtccaccctgcctttgtgcagatggttgagcctgcccaattcttcaagcaccagtttgccgagtttgcggctgtcgcgcagcgtggcggtttgggtcatgtcgagcagggcggtatcgacattgcggttgccgctggtcggtacgccgccgaccgcgtcggcattgttttgcgtctgttccaagaatttggcggcagagctggttgcgcctttggtgtttaacatataaacccccgtgccgcgcgcggaggggctggtgaaggcatcggcgtggatggagacaaatacgtccgcccgccgtgctcgccctttggcgacacgcacgcccaatgggatgaacacgtcttcgttgcgcgtcataaatacattgtaacctaatgcttccaactgatttttggtttccctggcaatggataggacgacatgtttttcctgtagaccgcccgggctgatggcgccggggtcttcaccgccgtgtcccggatcgagcatgatgacgggtctgcgcccgtttctgccgcgcccgggttggggcgtggtgttttgggcgaggtcggcttcgggagagccgcgcagggttttattcaggctaccgttgagcagtgccatcatcggatcgtcggcatccatcccgtgcggatagaggtcgacgacgaggcggttcttaaagccgccgacgggcggaagcgcgaagacttgtgcgtgggtgggctgtttcaaatcgatgacgaggcggacggtggtcggcgtgttctgacccgcgcgtatgctgcggataaaggggtcgtctgccatgactttctgagacagtccgtgcaatacggtattgatgttcgcgttttgtatgtcgacgaccagcctgcccgggttgtcgagcgtgaagtgctggtatttgagcgcggcggtgctttccagcgtcaggcgggtgtaggtgtgcgacggccatatccgtgcggcggtgaattgcggggcgcgtaccgttttggcaacggcggatgcgatggggcttagggcgaacagtgtgccggcggtgcggcggatgatttgtcttcgtgtcagtttgatcatagcggcaggctttcgcgtcctcgttcggtatgggcggtcagcaggcattttctgccgtcgccgtcgtgtgtcaatgttgcggtgatgtcggcgggcggcgtaaattccccgccctgttgcggccattcgatcaggcagacgctgtttgcggcaaacagttcgtcaagccccgcgtcttcccattcttcggggaacgagaagcggtagaggtcgaaatggtgcagggtgaagcgttccagcggataagattcgacgatggcgtaggtcggacttttgactgcgccctgatgacccaatccgcgcaggatgccgcgtgtcagcgtggttttgcccgcacccaaatccccttcgagataaatgaccagcggtgcgtttaaacgggaagaccacgccgcgcccaaatcgagtgtggcggcttcgtcggcaaggaatcgggagatagagggtaaatcagacatggaaacggtttgttgtaaggtctagggtattatgggcagttttgcaggttttgcaaactttgcacccgaggggcggatgcttcttgtccgagcattataacagccaaatccgcgttctgctttcagacggcaacggctgtcaagaaaaagcggcgcgtgtacaatacgcggattgtatgtttaggacggattggaaaaagaatggaaaatatcggcaggcagcgacccatcggcgtttttgactcgggaatcggcggtttgaccaatgtgcgagcgctgatggaacggctgccgatggagaacatcatttatttcggcgacacggcgcgcgtgccttacgggacgaaatctaaggcgaccatcgaaaatttctcgatgcagattgtcgattttttattggaacacgatgtcaaggcgatggttatcgcgtgcaatacgattgcggcggtggcggggcagaaaatccgtcaaaaaaccggcaatatgcccgttttggacgtgatttccgccggcgcgaaagccgcgctggcaacgacgcgcaacaataaaatcggcattatcgccaccaatacgacagtcaacagcaatgcttatgcgcgcgccatccataggaacaaccccgacacgctcgtccgcacgcaggccgcgccgctgctcgtccctttggtggaagagggctggctggaacacgaagttacccgcctgaccgtatgcgaatacctcaaaccattgcttgcagacggcatcgatacgctggtgttgggctgcacgcactttcccttgctcaagcccttaatcggcagggaggcgggcaatgtcgcgttggttgattctgcaattacaacggccgaagaaaccgcacgcgtccttgctcaggaaggattgctcaataccgacaacaacaatcccgactaccgtttttacgtcagcgatattcctttgaaattcagaaccatcggcgagcgttttctgggcaggacgatggagcagattgaaatggtgtctttgggttaaaacgatgacggaaagctgcccgagattacagaaacctaaaatcccgtcattcccacgaaagtgggaatctagacctgtcggtgcggaaacttatcggataaaacggtttctttagattttacgttctagattcccactttcgtgggaatgacgggattagagtttcaaaatttattctaaatagctgaagctcaacgcactggattcccgcctgcgcgggaatgacgaatttcaggtttctgtttttggttttctgtttttgtgaaaataacgggatttcagcttgtgggtatttaccggaaaaaacagaaaccgctccgccgtcattcccgcgcaggcgggaatctagacattcaatgctaaggcaatttatcgggaatgactgaaactcaaaaaactagattcccactttcgtgggaatgacggaatgtaggttcgtgggaatgacgggatgcaggtttccgtatggatggattcgtcattcccgagcagacgggatctagacattcaatgctaaggcaatttatcgggaatgactgaaactcaaaaaactagattcccactttcgtgggaatgacgggatataggtttccatgcggacgcgttcggattcacgactgcgcggaaatgacgggattttggtgtattccctaaaaaaataaaaaaacatttgcaactttgttaaaaataaaggctgtgttttaacgatgtgttgatatttaattttagaaaggtagctatttaatagttaccttttcttatttaaaaatagctttctcaaattccatgaacgcctcaatacgatatgcagatgctctatcgaaattaagtttcaacattttgtttattaaacattttattttagccatttttcaatatacccccaaatatacccccaatttgcacaagtcaaaattttaggcaggggttttgttgctcccatgatacgcgggcggatgccggcttttcgcgggggaaatacaaggggtctcggttcgggtgtcaaaatccctgtttcgtgttagtcatgtgggggggaagagggggttagaatgaagtaaagctgttgccctctccccgcaatagttccattaggcgcggatgaatgaatagtttgtccctgccgatgacgatttcttgcagcacacctatgtctgaaagctctttcaggtacttagaggccgtctgccgtttggctatccctgccgcttctaggttggcaatgcgtgtatatggctgctcaaacagaagatttaccagttcgtgcgtgtagattccttgtgcgtgtgtccgtatgtgttgccgtgtctgctcgaacaggcggcgtatcgcatctattttcgataccgtccaatcggcggtgtcagctacgccgtctaagatgtagattatccagctttcccagtcctgccgttcggttacgcctaaaagcaggcggtaatagtccgccctgttttcgatgatgtagcggctcaaatacaaaataggcaaatccaaaagccctttttcaatcaatagcaggctgttcaatatgcgccccgtccgcccgttgccgtccgtaaacggatggatggcttcaaattggtaatgtgccgccgccatgatgataagcgggtctaaatcgccgctttcgtgaataaaccgctcccaatttgccagcttgccgcgtatggtttcttctccttcgggcggggtatagacaacatttccgctgttgcctccttttagggctgtgccgcctgttttgcggatggccatttcgtaggggtgcttgatggcgttgcagaccatgatggcggtttgtgtgcataaagggcggctcgtcagtgattcatagcctgcaaacagggcggtgcggtattgcagggcttctttcgtggcagggtcttgccgttccgtatccatttgcagggattgaaacagcttgtccgtggtggttacgatgttttcaatttccgaacttgcacgggcttccataacaggaagggtgttaatcagcatggcttgattcggtatcaattctgccgcctgctttaaacgggcaagggatgcacgggcggctatacaacgtttcaggatggttttgctttcaatatcctgttttggcggcaggggtggtaaatcgttatagggaatattgggtttccagttgctcatatttaaaatttcggaaaatttaaagatgtttccagtatatgtttacgccgtgtatatatcaaggatatatgtttaaaaatttggcttttgtaagtatatgggaggtaaaaccgcccgcaaaagtcaatttgcatggggttaattcaaaatccgcccgcccttcatctgcccgcttccctaaaaaaaccgtatatatataactgtccgcattctatcgctccggcgacgatacccatatttccaagtttgtgtatcaaaattgtatatcgggcatagactatttcggcgaggacgaagatatagatttccacgattgaatacatggaagccaagtacgtctatcaacactatattaaaacacagcctttttttttgaggtttcgggtaacttttaaaccgtcattcctacgaaaacagaaaatcaaaaacagaaatctcaaatcccgtcattcccgcgcaggcgggaatctagacattcaatgctaaggcaatttctcggaaatgactgaaactcaaaaaactggattcccactttcgtgggaatgacggaatgtaggttcgtgggaatgacgtggtgcaggtttccgtatggatggattcgtcattcccgcgcaggcgggaatctagacattcaatgctaaggcaatttatcgggaatgactgaaactcaaaaaactggattcccactttcgtgggaatgacgcgattagagtttcaaaatttattctaaatagctgaaactcaacgcactggattcccgcctgcgcgggaatgacgaagtggaagttacccgaaacttaaaacaagcgaaaccgaacgaactggattcccactttcgtgggaatgacggaatgcaggttcgtgggaatgacggaatgcaggttcgtgggaatgacgtagtgcaggtttccgtatggatggattcgtcattcccgcgcaggcgggaatctagacatgcaatgctaaggcaatttatcgggaatgactgaaactcaaaaaactggattcccgcctgcgcgggaatgacgaagtggaagttacccgaaacttaaaacaagcgaaaccgaacgaactggattcccactttcgtgagaatgacgggatgcaggttcgtgggaatgacgtggtgcaggtttccgtatggatggattcgtcattcccgcgcaggcgggaatctaggtctgtcggtgcggaaacttatcgggtaaaacggtttcttgagattttgcgtcttggattcccactttcgtgggaatgacgcgattagagtttcaaaatttattctaaatagctgaaactcaacgcactggattccgcctgcgcgggaatgacgaagtggaagttacccgaaacttaaaacaagcgaaaccgaacgaaccggattcccactttcgtgggaatgacgaatttcaggttactgtttttggttttctgtttttgtgaaaataatgggatttcagcttgtgggtatttaccggaaaaaacagaaaccgctccgccgtcattcccgcgcaggcgggaatctaggtctgtcggtgcggaaacttatcggataaaacggtttcttgagatttttcgtcctggattcccactttcgtgggaatgacgcgaacagaaaccgctccgccgtcattcccgcgcaggcgggaatctagacattcaatgctaaggcaatttatcgggaatgactgaaactcaaaaaactggattcccactttcgtgggaatgacgtggtgcaggtttccgtatggatggattcgtcattcccgcgcaggcgggaatctagaccttcaatactaaggcaatttatcggaaatgactgaaactcgaaaaactggattcccacttttgtgggaatgacgcgattagagtttcaaaatttattctaaatagctgaaactcaacacactggattcccgcctgcgcgggaatgacgaagtggaagttacccgaaacttaaaacaagcgaaaccgaacgaactggattcccactttcgtgggaatgacggaatgtaggttcgtgggaatgacggcggagcggtttctgctttttccaataaatgaccccaacttaaaatcccgtcattcccgcgcaggcgggaatctaggtctgtcggtgcggaaacttatcgggtaaaacggtttcttgagattttgcgtcctggattcccactttcgtgggaatgacggaatgtaggttcgtgggaatgacgggatataggtttccgtgcggacgcgttcggattcatgactgcgcgggaatgacgggattttggtgtattccctaaaaaaataaaaaagtatttgcaaatttgttaaaaataaataaaataataatccttatcattctttaattgaattggatttattatgaacaatccattggtgaatcaggctgctatggtgctgcctgtgtttttgttgagtgcttgtttgggcggaggcggcagtttcgatcttgattctgtcgataccgaagccccgcgtcccgcgccaaaatatcaagatgttttttccgaaaaaccgcaagcccaaaaagaccaaggcggatacggttttgcaatgaggttgaaacggaggaattggtatccgcaggcaaaagaagacgaggttaaactggacgagagtgattgggaggcgacaggattgccggacgaacctaaggaactccctaaacggcaaaaatcggttatcgaaaaagtagaaacagacagcgacaacaatatttattcttccccctatctcaaaccatcaaaccatcaaaacggcaacactggcaacggtataaaccaacctaaaaatcaggcaaaagattacgaaaattttaaatatgtttattccggctggttttacaaacacgccaaacgagagtttaacttaaaggtggaacctaaaagtgcaaaaaacggcgacgacggttatatcttctatcacggtaaagaaccttcccgacaacttcccgcttctggaaaaattacctataaaggtgtgtggcattttgcgaccgatacaaaaaagggtcaaaaatttcgtgaaattatccaaccttcaaaaagtcaaggcgacaggtatagcggattttcgggcgatgacggcgaagaatattccaacaaaaacaaatccacgctgacagatggtcaagagggttatggttttacctcaaatttagaagtggatttccataataaaaaattgacgggcaaactgatacgcaacaatgcgaataccgataacaaccaagccaccaccacgcaatactacagccttgaggctcaagtaacaggcaaccgcttcaacggcaaggcaacggcaaccgacaaaccccaacaaaacagcgaaaccaaggaacatccctttgtttccgattcgtcttctttgagcggcggctttttcggcccgcagggtgaggaattgggtttccgctttttgagcgacgatcaaaaagttgccgttgtcggcagcgcgaaaaccaaagacaaacccgcaaatggcaatactgcggcggcttcaggcggcacagatgcggcagcatcaaacggtgcggcaggcacgtcgtctgaaaacggtaagctgaccacggttttggatgcggtcgagctgaaattgggcgataaggaagtccaaaagctcgacaacttcagcaacgccgcccaactggttgtcgacggcattatgattccgctcttgcccgaggcttccgaaagtgggaacaatcaagccaatcaaggtacaaatggcggaacagcctttacccgcaaatttgaccacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggagaaagcagtagtcaagctgatgctaaaacggaacaagttgaacaaagtatgttcctccaaggcgagcgcaccgatgaaaaagagattccaagcgagcaaaacatcgtttatcgggggtcttggtacggatatattgccaacgacaaaagcacaagctggagcggcaatgcttccaatgcaacgagtggcaacagggcggaatttactgtgaattttgccgataaaaaaattactggtacgttaaccgctgacaacaggcaggaggcaacctttaccattgatggtaatattaaggacaacggctttgaaggtacggcgaaaactgctgagtcaggttttgatctcgatcaaagcaataccacccgcacgcctaaggcatatatcacagatgccaaggtgcagggcggtttttacgggcccaaagccgaagagttgggcggatggtttgcctatccgggcgataaacaaacgaaaaatgcaacaaatgcatccggcaatagcagtgcaactgtcgtattcggtgcgaaacgccaacagcctgtgcgataagcacggctgccgaacaatcaagaataaggcctcagacggcaccgctccttccgatgccgtctgaaagcgaagattagggaaacactatgcaacagcaacatttgttccgattcaatattttatgcctgtctttaatgactgcgctgcccgcttatgcagaaaatgtgcaagccggacaagcacaggaaaaacagttggataccatacaggtaaaagccaaaaaacagaaaacccgccgcgataacgaagtaaccgggctgggcaagttggtcaagtcttccgatacgctaagtaaagaacaggttttgaatatccgagacctgacccgttatgatccgggtattgccgtggtcgaacagggtcggggcgcaagttccggctattcaatacgcggcatggataaaaaccgcgtttccttaacggtggacggcgtttcgcaaatacagtcctacaccgcgcaggcggcattgggcgggacgaggacggcgggcagcagcggcgcaatcaatgaaatcgagtatgaaaacgtcaaagctgtcgaaatcagcaaaggctcaaactcggtcgaacaaggcagcggcgcattggcgggctcggtcgcatttcaaaccaaaaccgccgacgatgttatcggggaaggcaggcagtggggcattcagagtaaaaccgcctattccggcaaaaaccgggggcttacccaatccatcgcgctggcggggcgcatcggcggtgcggaggctttgctgatccacaccgggcggcgcgcgggggaaatccgcgcccacgaagatgcaggacgcggcgttcagagctttaacaggctggtgccggttgaagacagcagcaattacgcctatttcatcgttaaagaagaatgcaaaaacgggagttatgaaacgtgtaaagcgaatccgaaaaaagatgttgtcggcaaagacgaacgtcaaacggtttccacccgagactacacgggtcccaaccgcttcctcgccgatccgctttcatacgaaagccggtcgtggctgttccgcccgggttttcgttttgagaataagcggcactacatcggcggcatactcgaacacacgcaacaaactttcgacacgcgcgatatgacggttccggcattcctgaccaaggcggtttttgatgcaaataaaaaacaggcgggttctttgcccggtaacggcaaatacgcgggcaaccacaaatacggcggactgtttaccaacggcgaaaacggtgcgctggtgggcgcggaatacggtacgggcgtgttttacgacgagacgcacaccaaaagccgctacggtttggaatatgtctataccaatgccgataaagacacttgggcggattatgcccgcctctcttacgaccggcagggcatcggtttggataatcattttcagcagacgcactgttctgccgacggttcggacaaatattgccgcccgagtgccgacaagccgttttcctattacaaatccgatcgcgtgatttacggggaaagccacaggctcttgcaggcggcattcaaaaaatccttcgataccgccaaaatccgccacaacctgagcgtgaatctcgggtttgaccgctttggctctaatctccgccatcaggattattattatcaacatgccaaccgcgcctattcgtcgaacacgccccctcaaaacaacggcaaaaaaatcagccccaacggcagtgaaaccagcccctattgggtcaccataggcaggggaaatgtcgttacggggcaaatctgccgcttgggcaacaatacttatacggactgcacgccgcgcagcatcaacggtaaaagctattacgcggcagttcgggacaatgtccgtttgggcaggtgggcggatgtcggcgcgggcttgcgctacgactaccgcagcacgcattcggacgacggcagcgtttccaccggcacgcaccgcaccttgtcctggaacgccggcatcgtcctcaaacctaccgactggctggatttgacttaccgcacctcaaccggcttccgcctgccctcgtttgcggaaatgtacggctggcgggcgggtgttcaaagcaaggcggtcaaaatcgatccggaaaaatcgttcaacaaagaagccggcatcgtgtttaaaggcgatttcggcaacttggaggcaagttggttcaacaatgcctaccgcgatttgattgtccggggttatgaagcgcaaattaaagacggcaaagaagaagccaaaggcgacccggcttacctcaatgcccaaagcgcgcggattaccggcatcaatattttgggcaaaatcgattggaacggcgtatgggataaattgcccgaaggttggtattctacatttgcctataatcgtgtccgtgtccgcgacatcaaaaaacgcgcagaccgcaccgatattcaatcacatctgtttgatgccatccaaccctcgcgctatgtcgtcggcttgggctatgaccaaccggaaggcaaatggggtgtgaacggtatgctgacttattccaaagccaaggaaatcacagagttgttgggcagccgggctttgctcaacggcaacagccgcaatacaaaagccaccgcgcgccgtacccgcccttggtatattgtggacgtgtccggttattacacggttaaaaaacactttaccctccgtgcgggcgtgtacaacctcctcaactaccgctatgttacttgggaaaatgtgcggcaaactgccggcggcgcagtcaaccaacacaaaaatgtcggcgtttacaaccgatatgccgcccccggtcgcaactacacatttagcttggaaatgaagttctaaacgtccaaacgccgcaaatgccgtctgaaaggcttcagacggcattttttacacaatccccgccattttccatcatccccgatacaccgtaatctcgaaacccgtcattcccgcgcaggcgggaatccagtccgttcggtttcggtttttttgaggtttcgggtaacttctaaaccgttattcccgcgaaaacagaaaatcaaaaacagaaacctcaaatcccgttattcccgagcagacgggatctagggcgtaaaatctaaagaaaccgttttatccgataagtttccgcaccgacagactagattcccgcctgcgcgggaatgacgttatatttttcgcatttgataaaaaagaccgtttgaaattttttcagcggacgcaaagtattgcgtaaaatgctgcttataagaaacgcaaggcgggcgtaggatgtgcagcgtggacatagggctggctgtagggtgggcttcagcccaccaatcccaccgtttccacctattcccccaactccgtcaatgttatccattccgcccattcccaccgaaaaccgaaaccgccgtattcccaaaaacctttgatgcggtgaaattggtgggctgaagcccaccctacagcccaccctacggctcgccgaaatttcgtcattcccgcgcaggcgggaatccaggtctgtcggtgcggaaacttatcggataaaacggtttcttgagattttacgtcctagattcccacttccgtgggaatgacgggatgcaggttttcgtgcggacgcgttcggattcacgactgcgcgggaatgacgggatttcagtttgcggattgatttgaagttgcaaaatcccaacggatcggattaccgctttcgcgtttcaaagttacggcgttatcggaaaaacagaaaatcaaagctgcaagaatttatttaaaacaaccgaatttcaacggatcggattctcgcctgtagggaatgacggcggaaggttttttgtcttttctgacagatgtccgcaatctgaaatcctgaccgtgggaacgacggtatagtggattaacaaaaaccagtacggcgttggctcgccttagctcaaagagaacgattctctaaggtgctgaagcaccaagtgaatcggttccgtactatttgtactgtctgcggctttgtcgccttgtcctgatttttgttaatccactatataaatatttctatttcaatccaatataaaatgccgtccgaacatcgttcggacggcatttttaatgcttcaaatcagttggtgccgactttgattttctgccacaggctgacagacagttttttcgcatccgtgctcatttgcggcatcacgaaaccgtctttcatatcctgctcgttcgggaagatggaacgggtgttcaccagctcggcaggcattttttcgcgcgccggtttgctggcgggggcaaaggttacggcgatgccgtttttcgccgcgatttcggggtcgagcgtgtagttgatgtatttgtgggcattggcgacgtttttcgcatcggcgggaatcagccaagactcaatccagaagcccatacctttcggtgtcagcacttcgatgccgacgttgtttttcacttcctcggaacgtgctttcgccaagttcaaatcgccgccgttgcctgccgccaggcagatgtcgccgcgtgccagctcgtcgatgatggacgggctgaaacgtttgacatccggacggatagacttcaacacttccgccgccgccttcaagtcttcaggattcgagcctttggggtctttgcccaagtagttcagcaaaatcgggaacatttcactcggggtgtcccacagggcgatgccgcaggatttcagcttgtgggtgtattcgggtttgaacagcaaatcccagccgttttcgggcagcttgccgcccaaaagctctttgcccttcgccgtaatcgcaatcgtgttcacgccggagaaataggggacggcatactggttgcccgggtcggcggtttccagcattttcaagagttcgggatcgatgtttttatagttgggaatcaggtctttgttgactttttgatacgcgcccgcctcgatttggcgcggcaggaaggcgatgcccggcacgaccaaatcgtaaccggatttgccggtcagcattttggcttccagcgtttcattgttttcgtacaagtcgtaagtcagcttcagattgttggcttttttaaagtcttcgaccgtactctcatcaacatagttcgaccagttgtagatgttcagagtatcggtggcagcggcttcggcattggcagcagacgcagcgtctgcttgaggttgcacggcgtttttttcgctgccgccgcaggctgccagagacagcgcggccaaaacggctaatacggattttttcatacgggcagattcctgatgaaagaggttggaaaaaaagaaatccccgcgccccatcgttaccccggcgcaaggtttgggcattgtaaagtaaatttgtgcaaactcaaagcgatattggactgattttcctaaaaaattatcctgtttccaaaaggggagaaaaacgtccgcccgattttgccgtttttttgcgctgtcagggtgtccgacgggcggatagagagaaaaggcttgcatataatgtaaaccccctttaaaattgcgcgtttacagaatttatttttcttccaggagattccaatatggcaaacagcgcacaagcacgcaaacgtgcccgccagtccgtcaaacaacgcgcccacaatgctagcctgcgtaccgcattccgcaccgcagtgaaaaaagtattgaaagcagtcgaagcaggcgataaagctgccgcacaagcggtttaccaagagtccgtcaaagtcatcgaccgcatcgccgacaagggcgtgttccacaaaaacaaagcggcacgccacaaaagccgtctgtctgcaaaagtaaaagccttggcttgatttttgcaaaaccgccaaggcggttgatacgcgataagcggaaaaccctgaagcccgacggtttcggggttttctgtattgcgggggcaaaatcccgaaatggcggaaagggtgcgattttttatccgaatccgctataaaatgccgtttgaaaaccaatatgccgacaatgggggcggagatgaatacacggaatatgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctgaaccgcgtgttcagacggtatatcaagttgccgtgccgtctgaagccgccggcggtttggcggggcgggataaaaatttcgtttgaatccgggcaaacgcgtataatgtgcggtttgtacggactttgtcggaatcaagcaagatgacggaacctgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatcgctgctgtccgacagcagccgttcgtttaaaacgccggtactcgtgccgtttccccagcccggtatttggacgattgctttcgtgtcagggcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcattgaaatatgtgatttcgctgggtatggtcatccctgacgacctgcccgtcaaaacattggcaggacctatgccgtctgaaaaggcggatttgcccgaacaacaataaagccgccgttcagacggcattttctgttttcagtttaaatcaataaaaggtgattttatgcgtaccaactattgcggcctgatcagtgagcaatacttagaccaaaccgttaccgtcaaaggctgggtacaccgtcgacgcgaccacggcggtgtgatttttatcgacctgcgcgaccgcgaaggcatcgtccaagtcgtgatcgatcccgacacgcccgaagcgtttgccgctgccgattcctcccgcaacgaatacgttttgagcattaccggccgcgtacgcaaccgtcccgaaggcacgaccaacgataaaatgatttccggcaaaatcgaaatccttgccaaagaaatcgaagtcttgaacgccgccgccacgccgccgttccaaatcgacgatgaaaacatcagcgaaaacgttcgcctgaccaaccgcgttatcgacttgcgccgtccggtgatgcaacgcaacctgcgcctgcgttaccaagttgctatgggcgttcgccgctacttggacgcgcaaggtttcatcgacattgaaaccccgatgctgacccgctccacgcctgaaggcgcgcgcgactacctcgtgccgagccgcgttcatccgggcgagtttttcgcgctaccgcaatcgccgcaattattcaaacaactgttgatggtggcgggtttcgaccgttactaccaaatcaccaagtgcttccgcgacgaagacctgcgtgccgaccgccagcccgaatttacccaaatcgacttggaaacctcgttcttaaacgaggatgaaatcatggacatcactgaaggcatggccaaacaagtcttcaaagatgctttaaatgtagatttgggcgacttcccacgcatgccttactctgaagccatgttctactacggctctgacaaaccggatatgcgcatcaacttgaaatttaccgagttgaccgacctgatgaaaacggaagaattcaaagtcttccgtggcgcagccgacatgaaaggcggccgcgtggtcgctctgcgcgtgccgaacggcgcagaattcagccgcaaagaaatcgacgaatacaccaaatttgtcggcatctacggcgcgaaaggtctggcatacatcaaagtaaacgatgtcagcaacctttccaacggcgaagacagcggcctgcaatctccaatcgtgaaatacctgtccgaaaacgccctgaaagaaattatcgcgcgtaccggcgcgcaaaacggcgacatcatcttcttcggcgcagacaaagccaaagtcgtgaacgaagccatcggcgcactgcgtatcaaagtcggcttggagcacggcaaagacaacggctatttcacagacgaatggaaacctttgtgggtcgttgatttcccaatgttcgaatacgacgaagaagccgaccgctacgttgccgtacaccatccgtttaccgcgccaaaagaaggtcatgaagacctgatggtttccgacccggcaaattgtttggcacgcgcctacgatatggtattgaacggctgggaaatcggcggcggctctatccgtattcaccgcgcagacgtacaagagaaagtgtttgccgcgctgaaaatcagccctgaagagcaacaagagaaattcggcttcctcttggacaacctgaaattcggcgcacctcctcacggcggtcttgcattcggcctcgaccgtctggtaacgctgatgaccggtgccgaatccatccgcgacgtgattgccttcccgaaaacacaacgcgcccaatgcctgctgaccaacgcgcccaacagcgtggacgacaagcagttgcgtgaattaagtttgcgtttgcgccagaaggcaaccgaaactaaagaagtataaggaaaacggagccgtttgacggctctgtttttttcagacggcatttacgcttcttgacttccctctaattcaaacctaattttgctgtgttttaatggcggtattgaaaaacacatcttgttcaatcaaccgataaaaaaaggactgaaaatgaaaaaactgttattggctgccgttgtttctctgagtgccgctgccgcatttgccggcgactctgccgagcgtcagatttacggcgatccccattttgaacaaaaccgcacaaaagctgtgaaaatgttggagcagcgcggttatcaggtttacgatgtcgatgccgacgaccattggggtaagcctgtgctggaagtggaagcctataaagacggccgcgaatacgacatcgtgttgtcttaccccgacctgaaaatcatcaaagagcagctcgatcgctgactcctttgatggaaagatgaaccaaaatgccgtctgaagcgttcagacggcattttgcctgttcctcatcaggtatgaggcaggcttttcttattaaaaaaatgacatttcacgctgatttgttataatcattccttttcaacacgacagacggagcaggtttattatgcctatccttaccatccgtgaagtgtgcaacattaatcattggggcataggttattatgatgttgacgattccggcgaaatcatcgtccgccccaatccctcgcaacacaatcaaactgtttcactgcaaaaactgactgaagccgtgcaacaaaaacatcaggcgcgcctgcctgttttgttttgttttccgcaaatcctcgaacaccgcctccgcgacattaaccgcgcctttcagacggcacgggaagagtgcggctataagggcggttattgtttggtttaccctatcaaggtcaaccaacaccgccgcgtcatcgaatcgcttatgtcaagcggacaaccgcatggtttggaagctggttctaaagccgaactgatggcggttttggcacacgccggcaaccggcaaacattaatcgtctgcaacggctataaagaccgtgaatatatccgtttcgccttgatgggcgaaaaactggggcatcaggtttatttggtgattgagaagctgtccgaaatacaaatggtattggaagaggcggaaaaactcggcatcaagccccgtttgggtgtgcgcgccagactggcttcccaaggttcgggaaaatggcagtcttcgggtggggaaaaatcaaaattcggcttgtcggcttcccaagttttgcaactggtcgatattttgaaacaaaaaaacaggctggattgcctgcagcttttgcatttccatttgggctcgcagcttgggaacatccgtgatgttgccacaggtgtacacgaatcggctcggttttatgttgagttgcacaaactgggggtaaatatccgctgttttgatgtaggcggcgggcttggcgtggattacgaaggaaaccgcacacaatcggattgttccgttaattacagcctcaacgaatatgccgccacagtcgtatggggcatcagtcaggcttgtctcgaacacgggctgccgcatccgacaatcatcaccgagagcgggcgcggcattaccgcacatcacgccgttttggttgctaatgttataggcgttgaacgttacaaaccgcgccggctggatgcgccatcgcccgaagcaccgcgtgtgttgcacagtatgtgggaaacttggacggatatttccgcctcgcgggaaaaacgttccttacgcagctggatacacgaagggcagtttgatcttgctgatgtgcataatcagtataatgtcgggctgttgagtttggcgcaacgtgcgtgggcggagcaactgtatttaaatatctgtcatgaagtcggcgaattgtttaatgaaaaacaccggtctcaccgaaccattattgacgaattgcaagaacgttttgccgataagctgtatgtcaatttctcactcttccaatctttgcccgatgcttggggcatagatcaacttttccctgtttgtcccattaccggtttgaatgaaccgattgcgcgccgcgccgtgttgttggacattacctgcgattcagacggtacgattgaccactacatcgacggagacggcatcgccggtacgatgcctatgcctgattatcccgaagaagagccgccgcttttaggcttttttatggtgggagcatatcaggaaatactcggcaatatgcacaatcttttcggcgacactgccactgccgatgttgttgtaggggaagacggacaatttaccgtcatcgattacgatgaaggaaacaccgttgccgatatgctcgaatacgtttatcaagatccgaaagagctgatgaaacgctatcgcgaacaaatcgaacattcagaccttcctgcctcgcaggctatgtctttcttaaaagaactcgaagcggggcttaatggttatacctatttggaagacgaatagacgcatcaaggcatcggatatgtcgtctgaagcccgattttcttactcaaacaccaatcatcacgaccgattgaaaccaattacaaggaatcattacgatgcaatacagcacactggcaggacaaaccgacaactccctcgtttccaataatttcgggtttttgcgcctgccgcttaattttatgccgtatgaaagtcatgccgattgggttattaccggcgtgccttatgatatggcggtttcagggcgttccggcgcgcgtttcggtcctgaagccatccggcgcgcctccgtcaacctcgcttgggagcaccgcaggtttccatggacatttgatgtgcgcgaacgcctgaacattattgattgcggcgacttggttttttcttttggcgacagcagggattttgtcgaaaaaatggaagcgcacgccggcaaattactttcttccggcaaacgctgtttgagtttgggcggcgaccatttcattaccctaccgttgttgcgcgcccacgcccgctatttcggcaaactcgcactgattcattttgacgcgcacaccgacacctacgacaacggcagcgaatacgaccacggtacgatgttctataccgcccccaaggaaggcctcatcgacccgtcccgttccgtacaaatcggcatacgcaccgaacacagtaaaaaattgccttttactgtgttgtccgcccctaaagtcaatgaagacagtgttgaagagaccgtccgtaaaatcaaagaaaccgtcggcaatatgcccgtttacctgactttcgacatagactgcctggacccgtcgttcgcccctgggaccggtacgcccgtatgcggcggcttgagcagcgacagggcattaaaaatcctacgtgggctgacggatctcgacatcgtcggtatggatgttgtagaagttgccccctcttacgaccaatccgacattaccgctttggccggtgccacaattgccttggaaatgctttaccttcaaggtgcgaaaaaggactgaacgtccggcatcccccgggttttcgccgtgccgttcaaacggcgtattcagtctaatgaaaattcaaatactgaaacaaaagttgcccggagccgcatatcggaaagacggtgaaatatcagaatatatcttataaaacaattagttaaatattatttttccgatttttcgggacggtcttttttacggaggtcaatatgatgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaagggaaaaataaaataaatttccaatctgtgtttatttgattgggcgactattatcgtgaaatatgccgtctaaagccttcagatggcatatttgtgcgcttgaatgttgcagaaagcggcaggcggcggtgtaggaaaagccaaacaaaaaccaaaccgcctatcaacttctgataaacataagcattaaataatcagaaggttattcaattacctaaacgcaaatttccctgccgtatcacatctattgaaaataatacatcaaccggctcggaagcagcctgatcaggtgtttctacttgcggcgatgaatcggcagccggttcggtataggcagtcggcgtgccgtcggattgggtatttaaatgcggttgtgcctcgggcgtgtgtacatcaggcacttcgggcgtgcgtgtctcggatatttcggcagagttggtttcctcagtttgttcaatgacttcagcttggctgtatgaggaagaaccctgtatccacgccagcgatttgagcggcatcttcatcttgccgtttttgccgcaggtcaggcagacggccgatccggtgcggtctttgagtacagcatcgactttctcgggcgcgatggttttaccctgtgtttttgcccattgcgcaatactttttttcagagaggcgatgtcaaggttgttcttaccgtaagggtcgcggaaggcggcaagccacaggttgcgatccgcatcttcattgagacccgccatttgatagatgacggaggcgggcgagccgctggcgatggttttggcaaactcgagcgcgtcgggcgatttcatgcggacgcagccgtgactccgaaccccggggacgctggccggcgcattggtcccgtgtatgcccaaaccgagtttggggtcgcctaagcggacaaaaaccggccccaaagggttgtccgggccggcggctatggtttttacgccgtcgccgcgttctttctgtatggatttggggatgtaccaaacagggttataggctttcgcaccgattttatgttcgcctagattggtttgcgtcatcgcccgacctactgcaacgggataaaccttggtcagtttgccgtcggtgtagaggaacaggcgttgctgagggatgttaatgaagacatgttgaccttgtgcgacgggggagacatcgggaatgatggtgtttgcgtatgaaaaaccgcttatcaatagtgcagcagtgcggcagattgttttattcatatcaaaatatggtgtgtgtccgataggttttcggcaaatcatacctgaaaccgtaccaatttgtgcgaaaatatgcgcttcggtacagtgcggacggattgggtaatggcaacggaaacaaatgtcgcggaaatttccgccttggattatgaaggcaggggtgtggcaaaggtcggcggcaaaacggtttttattaaaagggcattacttgattgtttgatgctgggttggttcaggctttaactcaggaatatttacatcataatgaaggtttttaaacaacagcttgaacaactcggcgcgcaaaaccaatatcgttcgattccggatttgattcatcaagggcggtatattacgcgggaaaaccgcaaaatgctgaatatgtcgtctaatgattatttgggtttggcatcagatgaaaacttgcgccggtcttttttgcagcaatacggcggtaattttccctcttttaccagttcttcatcgcgtttattaacgggcaactttcctatttataccgatttggaagagcttgtcgcacaacgtttccaacgggaaagcgcgttattgttcaacagcggctatcacgccaatctcggtattttgcctgctttgacgacgacgaaaagtttgattttggcagataaatttgttcacgccagtatgattgacggcatccgtttgagccggtgtgcgtttttccgttatcgtcataatgattatgaacatttgaaaaatctgcttgaaaaaaacgtcggaaaatttgaccgcacttttatcgttaccgaatctgttttcagtatggacggcgatgtggcggatttgaaacagcttgtccaattaaaaaaacagtttcccaatacttatctttatgtggatgaagcccacgcaatcggtgtttatgggcaaaacggattggggattgccgaacgggataatttgattgccgagattgatttattggttggcactttcggtaaagccttagcctcggtgggggcgtatgccgtctgcaaccaagtattgaaagaatgtttgattaatcaaatgcgcccattgattttttcaaccgcattgccgccgtttaatgtggcttggacttattttatttttgaacgattgccgcaattctcaaaagaaagaagccatcttgagcagttaagcgcatttttacggcgggaagtggcgcatcggacgcaaataatgccgagccaaacctgtatcgtcccctatattttaggcgggaatgaagccacccttgccaaagcggaatacctgcaaaggcagggttattattgcctgcccatcagaccgtcgacagtacccaaaaacacatccagaatccgcctgtctttaacggcagatatgacaacggatgaagtgcggcagtttgcggcgtgcctgtaaggatatgatatggaaacaaaattttacaatcatcaaggcggacatttaatcctgtattttgcaggttggggaacgccgcccgatgctgtaaatcatttgattttgccggaaaatcacgatttattgatttgctatgattatcaagatttaaatttggattttgatttttccgcctatcggcacatccgtttggtggcgtggtcaatgggcgtttgggcggcagagagggcattgcaaggaataagattaaaatccgcaacggcagtgaatggcacaggtttgccttgcgatgataatttcggtatcccttgcaccgtttttaaaggcacattggagaacctcacggaaaacacccgtttaaaatttgaacgcagaatgtgtggcgataaagcatcttttgaagattaccaacaatttcccgcacgcccgtttggcgaaattcatcaagaacttatcgcactttttgcgatgatcgggcaagatagacgtacagatcttatccgctggacaaatgccttggtcggatcgggcgataaaatttttatgcctgccaatcagcaccgatattggacaccgcgttgcaccgttcgggaaattgacgtcggacattacctgttttcaagattcacccattggtcggcactatggaatcactgactgccataaataaatcgcgcattcggcaggctttccaaaaagcattaaacgattatgaccggcacgccttaatccaacaaaaaatgacgattaatttaatgacgcatttgcaagattatttgccggatatgccattggaaaacgtgttggaattgggctgcggctcaggaatgttgagtgccttgctgcaaaaacagatttcagcgaattattggttatttaatgatttgtgcaatgtgcagccccaactggctgaaaaactgccgcaatcctttgatttttattgcggcgatgcggaaaactttccttttcaacgacaatttgacttaatcgcaagcgcatctgccgtgcaatggtttcatcaacccgacgcttttatcacccattgcaaaacaggcttgaaaacaaacggattattggcggttgcaacctttggcaaagacaatttaaaagaagtccgccaaattacaaatataggcttaaattacccgactttatcccaatggcaggcttggttagccaaagattttgagcttttatggtgtgaggattttacggtaatactagactttgatacgccgtcagatgtactcaaacaccttaaatatacaggcgtaacagccacgaaccaaaaaaattggacaagaaaaaatctcaatggatttattggcgattacttgtcggcgttcggtatgccgtcgggcaaagtgcgcctgacttatcatccgttattttttatcgcgcgctactctgcggcgggcaggcaataaggcagcttatgggcaaagttatttttatatcgggtattgatactgatgtgggtaaaaggtaatatggcgaggcttgtgcagaaggcatattgttaaacgttaaattatggtatgatttaaaacttacaagtctatttcagtaaatcgttaataataaaagcggacaatggccgttgcaggcggtcagctatccgctcgttacggtatcgggagtatcctttggaaaactcattaattatcggtttggcactggcggtattgctgatgcttttggttatgcgtgcgaagcagggtaagaaaacaccgaagcgcaaatcccaaggtgtcggcaatacgcaggggcagacacccggaagcaatgattcggactgggtcgatcagattggacaatcggtttcagacggcacgcaacccgactggtcttggaacgaaagtgccgagaccgcatccgccgccgtatccgcgcaagaagtcgatccgcttacggagtatcaggtttataagcaattcggttatcagggcaaggctgccgaatctttggctgcctatctggacggcattccggatggtgaagcgaaacctgaaaaccttatccgcgagctgctcgatatcaatctcgaagtgggggatgtcgatgttttggcagacaatctgcaaaaatacggcaaactgattctttccgaacttttggcaaaatatatcgaacaggcattacagcgcgattcaaaccatttgcgtatccgcgtcttggcggaagaaggtttgggatggggtactcaggagattgaaaaacgtgcggaaggcggttctgcgacggcagcttccgcatcgcccccgccggatgccggcggtaaggcttatgaagccgaagaaatcaagcgcatcccgattgtgcggggcaaaaaagacgtgtccggaatcagtcaagaggaaatcggtgcgattgccggtttggtccgtgccgatcaaggtgcgaaaatccttaaagacaaagtcagctatgaaacggcatcgaaacaatacgaccgtgccatccaaacttccgaaaaacctgcaaacctgattatcgatgcgttgaaactcgattaccaacacgcggacatagaccgttttgccggacatttgtggaaactttaccaaacgttgggcaactacggcaggcaggttaaagagcggatgctggggtgggggtacagcttgggttaccatgaagttttcgatgatttggaaaaagggccgaacgaccggcaaatcaaagacatcggtatggggcacgggtatctgccgaaaaatatacagaaattcaaatcgcaacatcgggatttggtgcttcaagattcttcgttgattaacaccggttcgtctccggcagacgatgcggttaaggaagtagagtcgttgctgatgtatggtcagattgaagcggcaatggatgtgttggagcaggcggtattgaaatatcccgacgagtcccagctttatattacgttgatcgatatttatgaacgtactgaagattgggataggttggggcagtttttaagggtattgagggaacgtgcggacaggcttcctgaagaggtcgttatgctgatgagccggctgctgcagcgtatgaatcaaaatattaaaaaaataaaacggtacggaaaataaaaatggaagttcaactgccgaaaattaaaacagtacgcgtaatgttggcggggatgacggcgcagcaggaatccgttttcaaaatggcattcaaaatgcacaataccacccgttatgaaacagtatccccttcagacggcagtgccgtgcccgatttggttttggcggataccgatgccgagggcggttttgaactttggaaagagcttgccgagcgttataaggatatacccgtcgccgtctgttcggagaaagttcccgattctgaagttccctacctgcccaaaccgattcggtttgaaacattgtttcctatgctccgcaaattgttgcagggcgagaatgtttatgggaaatcgtttattgcacccgcagaccggtcggcgaaaaataacgggaatgtgcagcgtacggttacgatacgccagtttaacccgaataaaggattattgggggcgttgcggtttgcggaaaagaacaggcaggacatcgctatcttgcatggaaataagccggtccttattgttttcccctcgatacaacgggttttgctgacagaaagtgtgcaaaaactcgaagaattgtgcaaagacgaaaatttgcaggtcagctgcaagactgttcccgataacccgcaatggcgcgaaaaggctaaagtaggcattatgtcctgtatgtggcagttttccatttggacagcgcagggcaggttgatttatccgatttctcccgatactccgtttacgttgaaatcttggccaaacctgacccggttggcaaatgtgccggggtcgatacgcttgtcggcatttctgaccaaggcatccgtcaaccttaacgtgttgtataaagtgatgcctttaaacctcaatgatattctgaattatcttgcggcaacctatacaaccgggtttttgtcggtagatttaaaaacggtttcacaacaggcatactccgatatggcggataaaataaatatcggagccgattctgcctctgatagtgaaatgatgaaaaaagcggaaaaaatcacaacaccatcccaatcccagtcgcgcggccttctgcaaaggctgatgaaaaaactgttgggcagctaagaggcggagagatgagagaaaataaaattattttcacaggacctgtcggcgtagggaaaaccactgccattgcggctatttcggacgaagcactcgttcagaccgatgcttccgcatccgatatgactttggataggaaaaggaatacgacagtggcgatggactacggggccatcagcttggatgaggataccaaagtccatttatatggtacgcccggtcaggaacggttcaactttatgtgggaaatcttaagccaaggcagtatgggtttggtcttgcttttagataatgcccgaaccaatccgttgaaagatttggaattctttttacattcgtttcgagggctgctggagaaggcacccgtcgttgtcggtattaccaagatggatatacgctctcagcccggtatcgacgtgtatcacaaatatcttgcaaaacataatcttaatgttccggtttttgaaattgatgcccgtaaggaagatgacgtaaaacaattggttagcgcaatgttattttctattgatccgggactggaggtttaatatggaatcaacactttcactacaagcaaatttatatccccgcctgactcctgccggtgcattttatgccgtatccagcgatgcccccagtgccggtaaaactttgttgcacagcctgttgaaagcagatgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggattttataccgccgttacagcaaccgcgtgtaaaacttgggagagaggaggggttatgcagcaattattgatttcaatccttgaagatttaaacaatacatctacggatattatcgcgtctgccgttatctcaaccgacggattgccgatggcgacaatgcttccttcacatttgaattcggacagggtaggggcgatttctgccactttgcttgctttggggagtcgctcggtgcaggaactcgcctgcggggaattggaacaagtgatgattaaaggaaaatcaggctatatccttttaagtcaggcgggtaaagatgccgtgttggtgctggtggcaaaagaaaccggcagacttggtttaatcctattggatgccaaacgtgcggcaaggcatattgcggaagccatataacatataaagattgcgggcttgcagataaagtgcaatcgattgtcaatttatattgacacgttcggtatttctgttttattattcgcgcttgttccccgatagctcagtcggtagagcgacggactgttaatccgcaggtccctggttcgagcccaggtcggggagccaaatttcaaaaccctctaagtattttcttagagggttttgttttaccggcggtcagaaacgcatttttgagatgattgttttgagatggaataaaatctttgcaaaattcctttcgtgatggttatgaaaaaataggggctgtcctggacagctaggataaactcgattttatagtggattaacaaaaaccagtacggcattggctcgccttagctcaaagagaacgattctctaaggtgctgaagcaccgagtgaatcggttccgtactatttgtactgtctgcggcttcgtcgccttgtcctgatttttgttaatccactatactaattgagacctttgcaaaattcctttccctcccgacagccgaaacccaaacacaggttttcgtctatttccgctaccaatcactccctaattctacccaaatacccccttaatcctccccggatacccgataatcaggcatccggggtaccttttaggcggcaacaggcgcacttagcctgagacctttgcaaatttgtcggtttcggggtcgtattggtagcctcgtgcctgtatgtcttctttgaaagtttcgtatacgtcgtgggctaaaagggctgttccgacatagggaaccgcccttgtgctgaatttcgcgcctaagcgggcaagtttgccgacccccgccaatacgccggcgcgggatacgctggcggttattttggcgttgattcgggcttttgcgcccgtagggatgtgtgttaaatctaccgtttttattaaatcagatgaataagttttactatttttaggtacaaacttatgaattttcgcaccttgtccggtatcaactgaaacagtttcagatatttttactgcatttgcattcgcttcaaacgaatacatcatcaaaattgcaattatcgacaatttcgcaaaattcaaatttgtatattttatgaccatctttcagggattctttaattaccatttctgaattatcagaaaatgagattagccaaatatcatgtttaattcttctattccagaaaaaagagaaacaatcaataacattttcagacttattaatcttcgcaaattcaacaaattcagattgcgctataaccgccatcgattgcccaaaatacttgctggacggctgatatttataaagtgccaactgcgcctgagtgataaacggcttgttcatggttctgcctttcaatgattgttttgaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataaggccgtctgaaacggtttttctgtttttagacggcctcttggcttagaccttgagaaccgcatgcgtgcttaatttattatctaatgaaaaaagtttccggctttcagacgaccttttgtaatattatcggcagcggctcaatgccaactttaaacctgctccgatttcttcagggctgttatccaatgataaaattacatcgtctgcatcaatggcatcccacgcttccagcttgacatggcggctcgggctgattttcaggcagccgttgtgcagccaaatatctacgctcatcatgtttttaaatagggcgcgtctggttttatagcccaagttcccgcatagcttggcaacccaatcctcatagcgttgccgaattttttcggtatcaaaaaaatcttggtcttctggactgtcataaacgaaagtcctgctgtttgccaatgcttgcaagaccgttgtgcctaaagtttcattgtcggtatccaatggcaggatatgggggggatataggtggtctggagcatatcgcccaaatcctgaccatgtttgaataatcaaggctctttcatttgccttatagccagcccaataatcttgttcttgattgaaagtcatttattcgatctccgtaattttgactgtaatgttttgacttttgccatactctaccacacgttgcaactgcaatctttgctccttattagtttgtgcgggtatggccagatggatttcgcgctgtttgatcatgtctgcccttaacggtacttctgataattcataacttttgaaatttgccgtcttatcgatgtaccctttcatggtactgtaaagctgttcgggtttggacaggcgtgccgtagtttgcgtatccagagttttggcactgattgccgtgcctgtaccacgatcaaaataatcaaatgttttaaaatttttaggtaaccttgcattggcagacaagcccttaccgacataatcctcccaaggcattccctgtccttcaatccccttgccccacttgataccgacttcggattgggacaggatatttcgctgtacgtcagcagttttcggagtcaaggaagttttcacacccgttgccaagtttcccaatttgcgcgtaatcagcgtttccaatccccatacggctagatttttcgcatcagatactaacggcgattcgtattctattggtgtacccaaagataggacaacttttttaccaaaatcggactggtaagtgccaaacaattgccggcttccttctgaggcctgtgtataaccaccggtcatacctgccgttgcaataagtccaccggccgcacagccaatcccggtactgcacagacctccgcctatagcacccgaaccgacaaaagtcgttgcacccaatcccatattgcccgcacccttaattttggtggcagcacggtcgtaactgctgcgtatatcattcaggctgttccatgttccatatttaaatgcatccgtccgcatcaatacgttttgttccgctacaaactgtttaccggcatcttggaggttttttagtcctttataaagagggtcgaagtcaggtacgccttccgcgcaccgggttaatgcacatgcagcggcttttaggcggtactgttcttcagccgatttgccttttgacagtttgttaaggatttgtgtttctttcggatgcagctgcctattgttccaatcgacattcgcccctactgccgccgtaccgacattcccgcccgccgcatagccgattgccgccccgccccgtgcagtatgctcctgcctatgccgccttctttccaggtgtcgtagcggctttggttttcggcaagataggcgtttacttggccgagggatgcgcggaaggcggctttttcggcttcgctgtccgtgttttgcagttcggcctccagcagggttcgggcttcctgataccgttcgtaactttgggtattgccgagtttgtcggcaacggccgctacggcttgggtggcgtttctgccgaactccttcgttacttccctttgcaggttgatctctttggcgaccgcgtctttgtcgaagctgtttttcagacggcctgagtgttgatccgcagtttcggtgtcgatgccggtgtagatacgcgcttcggtttcttttgcagtcctgcctgttcgggcaagttgtcccgcttcgtcggtgatgtgtatgttgcgggtgttgatgccgcttttcgtgatgctgctttgactgtcgctgtcgctgccgtagccggctgccaggcttatcctgtcggtaggtctgccttgtttgtcggtaaccgtgccgtcccagccgccgttcaggtcgaaactgccgcctatgccgaagcttttgccttcgtagcggctgtggttttgaatgtcgctatgggtgagggtggccgtctgaaaaaggtttttgcccttatcttctgcgctttggctagacgtgatgataccgcccttgaggtctgtgttgtctctgactttgatttgatagccgtcttctccggcataaataccgctttgctcggttaccgaagcatggtcggctcggattttgctttggctgtaatcgccactggcactgaagccataacctacggtcacttgtgcactggcgttttgttgtttgctttgataggtttcagtatcttgaacactttctatatgcaggttgcgcgtatctgcctgtatgcctttgccgatgagctgcgcacctttgagggtggtatccccgccgcttcgaatggtagttttaccggttgtgctgccgacatgggtgtggcggtgggttgcttttgtctgattgctgtggtggcttgttgaaagaaaggctgtctgaaacgtatttgttgtttcagacagcctcctggctcaaaccttgaaaactacatatgtgcgttccgcacatcctacgtattgagtttaggtttcacatgagctacggcttgctatgccgtcttttttccaggtgtggccgcggctttggttttcggcaaggtaggcgtttacttggtcagatggcggattttttgttcgtcgtagatgatggagacgctgataccggagtaagcgtagattgggtcttgacctcaaacctacacttgttttacataaaatttcgtgtctctatttgaaaaatctaaataacaacattctactttacctattgaattgattatagttgaaacaggaatattaagaagcctaatacccaaatcatcaatttcaaaatcattaattccactcttataaagatagcttattatttcatcattaatttttccaagccaattaaaagaaatatcttctaaaaaaaacttatttggttcaaatatctctatcgcttcaagctgatttttatcatcataaaaacaatggatattcaattcgggaaaaacatccataggaacccgagagtatgatgacttataaatttcttgtacatcagaactaaatattgcacgaacttgttttcgattcagatttgatgagataatatttctttctattttttttgaactaaaataaaaaattgccataatttttttgcctaaacaatattaccattttcgtaagatgcatagaacaaaccatgtcttatccattttgttccatcggcagacagataacgactatatctaaattttatttttcactctcataaaaaattttctgcaatattcaatatatttactttcttaaccatagcgtaaattcctcaggcttatatatttcagtataagtatgacttaaaggatatgacgccgcgtgttacgagttgcttcttttgatttcagggtttatataagttatggcttgcctgggctcgaagtgataaagagagtatttacttttcaactataaaaatatgagatagttccatgggaaaaccgtaatttaagttttaataaagcaccttctaggcgatataaaaattttctataattttcatttggtttatatttatatataagctgtatttcaatagtctcatagctactttctccaaaatcttcaaaaatttgacctgattcaatatattgaatatatgaatttattttttcttgcaacaaaaacaaatgctcgttatcccattttaagtgatcagaaatagttaatatgagtattccgttttcaatagaggctgaatcaattacattctcttccaaaatagacattatcttttcctttcaattataactttagtaggttcaattttggtcccctttggatagcccggttttcccttaccgaccactgttgctcccgttctttcaatttcaggaaaagcttttttctgatttttagtaagtggcgcagttattgaagccttacactctgtacaaacatcaagaccaccttctttcgaaataatatcaagcctagtttttacaccactttttgttttaactgtaatctgtctttgcggtttaaagccttgtttaactttcttctgataaatttccatctcaaaatcctcaccagattttttatttttttccagttgatctttacgatttttatgtttgattcccttgctagccaatgccgtatccggaatcctgtcccccttcgcaacattgccgtttgcagggatacggatattccccgcacccgccaataagggatcgctgccggtaactgtcggcttgatgtttttcaggttgcggatgcctgcaagaatcgggacttttatcctcggattggggttgacaaggctcgtcagtccttcggcaacgttcagtgcaaactcttcgtttttccgctctccctgcctgattttggtgtctttcgtcccgctgtgcagccaggtcaggttgcggtattcgggtttgtcctgtcggcggtattcctcaaacagcttcggatcgttgtaggtttgcggatttcttgcgccgtagtcgcggtagtcccaagtataacccaaggctttgtcttcgcctttcattccgataagggatatgacgctttggtcggtatagccgtcttgggaacctttgtccacccaacgcagtatctgcctgcggattctcattgccgcttcttggctgctgatttttctgccttcgcgtttttcaacttcgcgcttgagggcttcggcatatttgtcggccaacgccatttctttcggatgcagctgcctattgttccaatctacattcgcacccaccacagcaccaccactaccaccagttgcatagccgatggccgcaccgcccagtgcgttgaccgccgctttgcccgccggaccgaggttttccgccgctttgtccaaatacggtgcggcaagggaagtgccgccgccggccagtatgccgccgaggctgccggtcgtcagtccgcctgccgccccgtgcagtatgctcctgcctatgccgccttctttccaggtgtcgtagcggctttggttttcggcaagataggcgtttacttggccgagggatgcgcggaaggcggctttttcggcttcgctgtccgtgttttgcagttcggcctccagcagggttcgggcttcctgataccgttcgtaactttgggtattgccgagtttgtcggcaacggccgctacggcttgggcggcgtttctgccgaactccttcgttacttccctttgcaggttgatctctttggcgaccgcgtctttgtcgaagctgtttttcagatggcctgagtgttgatccgcagtttcggtgtcgatgccggtgtagatacgcgcttcggtttcttttgcagtcctgcctgttcgggcaagttgtcccgcttcgtcggtgatgtgtatgttgtgggtgttgacgccgctgcgggtggtgctgtttttgctgtctccgtcgctgccgtagccggctgccgggcttatcctgtcggtaggcctgccttgtttgtcggtaaccgtgccgtcccagccgccgttcaggtcgaaactgccgcctatgccgaagcttctgccttcgtagcggctgtggttttgaatgtcgctggcagtaagggtggccgtctgaaaaaggtttttgcccttatcttctgcgctttggctagacgtgatgataccgcccttgaggtctgtgttgtctctgactttgatttgatagccgtcttctccggcataaataccgctttgcccggttacggaggcatggtctgctttgactttgctttggcggtaactgccgcttgcactgaatccgtaaccgacagtaacttggacattgccgttttgctgtttgctctgataggtttcagtatcttgaacactttctatatgcaggttgcgcgtatctgcctgtatgcctttgccgatgagctgcacacctttgagggtggtatccccgccgcttcggatggtagttttgccggttgtgctgccgacatgggtgtggcggtgggtagtacttcccccttgctctttacctttaccgatatttcctccggcggtaattccaaacctgatgccgttgcctattttgacggctacgcctgcattccaaccactgcttttgtttttgctttgctcgctgccgtcctgtttggcagattggagtctgatatggttgtcggcaatgagggcagtacctgcatggccgatgacatcggaacctgtaatattgatattggactgctccccacttcctgttgccgcaagtgtggtttgccctttgccgataatttgacttgctgccgcttcggtgtaatgtcttttttgctcgttacgacttttctgttcgccgtaggtaatggacacactgatactggggctttgattgttgttttgaccttgtcccgcactgctgcttggagcaaattgttgcatttgttgggttgcttgataactctgccatgcagcattggctgcagccatggcattaacgcgtttatttttacttttgcccacattttgggctgcttgtatgaagttttgtgcagcttggacaaccgggacattgagggcgacggtaaggcctttttgttcctgggtatgggcgtagtcagtggcataccggttgtttgcgaactctacatctatgcttttggctgtgacggtattgcgcccctcggggctggagacggtactgccggtttgtcggtagcggtttcctgcaactgtaacggtgtctccattcaggctgcctataatgctgcctgtatggacaatattggtacgatcagtgtcatcggtagttttccggttaccgatagtaaagcccaatccgccagtacccatgacgcctgattttttgctctcgtggtattcattgccggtatagcgattatgggcagtagaaatatcgatgtcgtgtcctgcttttaaaacaatgcccttatcagaaataaggttgctgccgcgtacattgatatcctgcccggctgcaacaatcattttgccgccgccgatgttgctgccgactgcttcatcatgactgaagcggtagcggtcgtgtgttttggtactggaaaggatgcctttgctttttccgcttaccgaggtatccagttcggttatttggcgtccttcgctgatagtgacatcacgtcctgcggcaaggacggttttgccttcttcggcctccagttcgccttggcggatttttaagtcgttaccggctctaagcagtgcgccgttttgcgtgcggatactgctgccgacttcggtactttggcggacatggcgatggttctcgtcatctaatgtaccataggcttcgcgatgttcggtacggatggtgccgaggttgagattattgccggcggtaatttgggtagtgccgtctttaacttggttagagacggtggccgcattgaggttgatatcgttgctggcatgcagggataggatgccgtctgaagttctgttatctacttgttcagtatggcttccgaccacgttaatgccggccatacgatcgatggcggtattgccgttacgttcattaccggaagtttgggttgtaccgttaaggttgatattttgcgcttgggcagtcagcagtctgcctgcttgtacctgcccgccgtcgatattgatacttttttcagcttttaagccgatttggtcggcttgaatgttaccgttgctgttaatattccgtgcctggatgagtacggcctgtcgccccgcaatggtaccgctgttagtcaggttgccgttttgcagtttaagtaagacttgttcggcactaatcaggccaccggaggtattgagatcacctttgcgcgccagggcatagactttaggaaccagtacggtttgagtcgaaccgtcagacagggtgacggtttgattttccatccaaacgatatctgaagttaagcgggcaacttgctctgcactcaaggcgatacctggggtgagaccgaatgttttggcagcagtaaggccgttgtccatcagagctttgaattgttcttcatcactcctgtagccgtcgagtcggcggtagcctgttaactgatggatttgttcattaacaagtttttgttcgtagtagccgtcgccaagccgtttgtgtagatgattggtgtccaattgcagttgttgcaacatgtagtcgctgcccaaccagcggcggtagtctgcaaattgaggatcggtttcaaccaaccagcctttattgtcaggatgggtggtatagaggctgctgttaggcagagtaacagtagcgttatttaacgagaccacattaccggtatggatgcgctgaccattgacggctgccgtggatactccgtcaatcagtttgattgcagatgcggcgggttgaaaggaaggggaggcggcattctgttggatgacggatacaggcgtgtcgaagtcgtgggtaaatagttgggtatcatggtaaggagtatggtttctttcagtacggcgttgtctttttctaccgctgtaccatcctttttttgtaactgaatcccactgtgtgccgacagcatctgtgcgacctttgcctgttgtactttgattggtaatttctttctggtttaaatcatcagtgataatacgcccgcctactacaatccggctgtctttgttcagccaattttgacctgaggcagtcaaatcaccgcccacagtaatgtgtgccggccggttttcgatgatgcgttctttataagtctcgatgtggtagtctcggacatgccattggttggcctcaatacgagaaccattttttaaatggaacgtagcagtagtttggtctttttgtccttgcgagttgtcgaataaaccgtcttttcccgcctgatagtaggtattttgccccagtacggtgtagtcgcggacttgcttttccgctttggctaagtatgtctctgttttaaagtgattattgatattctgcatattccgaacggacatcaatgcatcaccttgtacttccaaaccggcactgccattaacaaaggtatcggccatgcctgccgcatgatgttgttcatccagtcgattacctacggcaaaaataccttcgctggatagtagggcaccttcttggttatgaatctctttcgctccaatatccaaacgtttccttgcagctattgcccccgctttggtactgccttccgtcgtttcttcccggttaagcagtatttgcgcgtccagggcaatatggttgccatagattttgcctgtcccggtgttggtcagggtttgacctgcaccgatgtgggtcaaaccgtcgctgttgatcaagcccctgttgtcaacatgctgttcggatgtgatgtccgtttgttctccaccaataattttgcctgtaacttggttatctatattgccggcattgagtttgagcgtatggcctgcttgtagggtatgggtatttttcagacggccttttatgcttagatttaattgtttgcctgcagtgaggtcgcgctctacgacgaaatcgtccgtcaaagcaatatccagtttgttaccggctgttaatgtgccattgttggcgagtgatttggcttgtagcgatacattaccggcagattgaatcgtgccatccgcattgtttaacgccaaagtgttttgatttttatcgtgaatagacaactgccggttggtggcaatttcaccatgttggttgtataggccgtctgaaacagctaattgtgcttggtttgcagataggagtttgccgttttggttgtctacatttcgactattgatagtcagttgttcggtagcagtaatatggccgctttggttagtcagttgctgactttggatgttaaccgtttcagcctctatacgtccgcgcgtattatctagagtctgaccttcggtattcagtcgtgcaacagaaacttttcctgtattgcgaagattattcttggtggtaacggttccactatcggcaagaatgttacctgcattatgtaaaccggcggtatcaagctgtaaatgtgcagctcgaatattgccttttttatcattgctcaagcggcccgaatgaatgagtgtcagattgttggcggcaatttctccggcattatgcagttcacggttatcaatcttgccggtttgagttaataagtgaccgctgtttttagcagtttgagtgttaacagccagatcgtgtgcctggagtttgccttttaccgtattgttaaatgaatcgcctgatactcgtagtttagccgcattcagactacccgaatttcccaaaccgttttgggcggcaatgtcaatttgcccacccgcattaattgatcctgcattgtcaaatgctcctgttgtttgaatgcgtcctacggcgtagttttttgcaggtgctgtaggtgaaacgggattgtttgaaccaggcttagataccgagacagtgctgctgcctgaacctgttgcagtactcggaatctgtggtatgactgatggattgggattcaaaccggtctgtggaacgtcacttacaccaatcttgccactgttatcgaatttgccggcagataccaaatccaatgcttgtgaacctgtttgagtaatattacctgtgttatccaaaccacctgttgacatatctaagcgggcagcctggatcgtaccgttgttttggtttttcagacggcctaaattacgaacagtcaatcgacctgaggataagaccgtacctgaattgtccagcgtctggctgtgaatattggcatcatcctgtgaggcaaccgtaccgctattatgaacattgcgggcatgaagtgaaaccgcatgattttctcccgtcgctgcaatcatgcccgtgttgaccagtttaccctcagcattcactgccacattgccggctgaggcaaaccattgcccttgattacgaatgcctgcttgctcgaccgtactgatcaaggtgattttgttggcatacatacctcctaatttgcctgtatcaatcgcaaataaagggatatgtgtgccgttgttggctgtattgtttgacgtattggcagcagcattattgagaataggcgaatgtgcatcacctgttgcggccacatcgttttgtcccgcgacgacacgaacatcttgtccccatacgggtgcatcaattttggaatgataactgagaatacgtgtgtaatcggtatcacgtgcatccaaaccgtgtccggcgattacaacattgccttgccttatcttaaagccgctaaggtctcctgcttgatattgcggttgggctgtcgtcaaagtggcacgggaagcattgataaaaccaccaccattgactgcaatccctgccggattggcaataacgacttctgcacgtcgtccgcccacttcaatatagccattcagttgtgaagaatggctgctgttgatttggtttacaaccacacgtgcttcgccccttgccaaccaaggattgccttgaatccaaccgcctagctgtgtttgggtgttgctgcgactgttgtttaaaatcgccccgcgattacccacatcaaactgggcgtattgattaacagaaacccctgccgaagtaggggtttgaatattgacttgcggtatgccgttacctgtttgcaggatggtaggctgttgctgtgcaggtgcggatttgtcggcaacgataccttgggcagtagcagaagaagaagtcaggataagggcagaaccgagcagtaatgaaagggagaatgagataacagagatagaatggataaaacccgcaaagcccgcaatatcatttggcaaaatacctacagcttgggtgtcggctgtgtttttgccctcgcgtttggcattttcagcaacggctatcatgcagtttcgatgtttgttaaatacaactttgtacagggtgcggttcatagtaagggctttcttaataatatttttataatcgtaaattagattaatttttaggggctgacgtagattaacagttatgccaggctacgaaaataaagataaccaattgtaaattaaacaatagagttcaaaagaaactgcttgaatttttcgtactccaagctaccgcccgttccgctgccgatattttgggtatggcgctgcgggcaatttccgttcccacttcggcgagttggcgcataatggaacgctcgcgcacgatttcggcatggcgccggatgttggcggcagacggagtattttgcgccagcgtaatcagatattcgaatccccccgccgcttccagctcttcgttccgctgcaaatcttcctgaaccgtgatgacatcggcaggacggctctcattgatcagtttggcaatggatcggaaaatcaggcggtgttcgtggcggtagaaatcctctcccgaaaccacatcggcaatcctgtcccaagccggattttccagcatcaacccgcccaaaacggattgttccgcctccattgagtgcggcggaagcgataatgagccgattcctccgtcttcagacggcatggctgtgtaatcgttcatggtacatccgacaaaattgcaatcttctattgtagcgtaaagcaggttcaattggtttccgtaccgcaaaacaggtagaatacgcgagttgccgggttaaataccttcctcaaccatcacagttaacataggaaataatttggcaatctgagaatcggctatccacctgtttgtcccttcagtcctaagcatacctgaatctttaacccaaattgttccatccttgtccttaaaacgtgtgccattagaaatcttttcccattcgtttaaaacgacttttgcatttttgttttcaggatttttggccccattatctttagccacatcttcaaatccccaacgttcctctacggcttttttcagaatattcagcctatgggctttagtcacgttctgaccttttgcaatgagcgaagcgatatatgcttccgccctgacccgtatcgttccggcttccaaatcagtcattccggcaaaaagttccgattgattttcaagagggatgtctttcgaccctattttatgtaggattgagaatgtaaaacctacaatttttcgtccttctttatgctgctcgtaggtaatggaaatatccgttttatcattgatctgcttgacggcgaaatccaaaaccttacgtttgaatagctccattttttgatactcgtcaggcatcatacccaaacgttcgcgcaactccattgtactgaacatcggtgtcttaccggctgcacgccatgaaataataatttcgtagagccgcaccgcgtatttactgctcaacgatgagacctgatcaagctcgtagcttgtgaagtttttttctagcatcgtaatcaaaggggcaacatttggtgcaaaaactaactctaccgttgcctgttgttcaatataggcgacttgagatacccaccttgtccgtactaccttttccccttttggtgttttttcgataaaactgaattggcgttcaaaaaggttgttacaggcatctttcaaagccttatacgccgtattacggttggtatggaaattattaacgatgcagaacttatccgttccatgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttattttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaacctctgaattttttactgatatttagacggtctttccttatcctcagaccgtcaaactttacctacgtacttggcgcgcagtacgttcatcttcaaaatggaatagacatgaataaaggtttacatcgcattatctttagtaaaaagcacagcaccatggttgcagtagccgaaactgccaacagccagggcaaaggtaaacaggcaggcagttcggtttctgtttcactgaaaacttcaggcgacctttgcggcaaactcaaaaccacccttaaaactttggtctgctctttggtttccctgagtatggtattgcctgcccatgcccaaattaccaccgacaaatcagcacctaaaaaccagcaggtcgttatccttaaaaccaacactggtgcccccttggtgaatatccaaactccgaatggacgcggattgagccacaaccgctatacgcagtttgatgttgacaacaaaggggcagtgttaaacaacgaccgtaacaataatccgtttgtggtcaaaggcagtgcgcaattgattttgaacgaggtacgcggtacggctagcaaactcaacggcatcgttaccgtaggcggtcaaaaggccgacgtgattattgccaaccccaacggcattaccgttaatggcggcggctttaaaaatgtcggtcggggcatcttaactaccggtgcgccccaaatcggcaaagacggtgcactgacaggatttgatgtgcgtcaaggcacattgaccgtaggagcagcaggttggaatgataaaggcggagccgactacaccggggtacttgctcgtgcagttgctttgcaggggaaattacagggtaaaaacctggcggtttctaccggtcctcagaaagtagattacgccagcggcgaaatcagtgcaggtacggcagcgggtcgcactgggcggtatgtacgccgacagcatcacactgattgccaatgaaaaaggcgtaggcgtcaaaaatgccggcacactcgaagcggccaagcaattgattgtgacttcgtcaggccgcattgaaaacagcggccgcatcgccaccactgccgacggcaccgaagcttcaccgacttatctctccatcgaaaccaccgaaaaaggagcggcaggcacatttatctccaatggtggtcggatcgagagcaaaggcttattggttattgagacgggagaagatatcagcttgcgtaacggagccgtggtgcagaataacggcagtcgcccagctaccacggtattaaatgctggtcataatttggtgattgagagcaaaactaatgtgaacaatgccaaaggcccggctactctgtcggccgacggccgtaccgtcatcaaggaggccagtattcagactggcactaccgtatacagttccagcaaaggcaacgccgaattaggcaataacacacgcattaccggggcagatgttaccgtattatccaacggcaccatcagcagttccgccgtaatagatgccaaagacaccgcacacatcgaagcaggcaaaccgctttctttggaagcttcaacagttacctccgatatccgcttaaacggaggcagtatcaagggcggcaagcagcttgctttactggcagacgataacattactgccaaaactaccaatctgaatactcccggcaatctgtatgttcatacaggtaaagatctgaatttgaatgttgataaagatttgtctgccgccagcatccatttgaaatcggataacgctgcccatattaccggcaccagtaaaaccctcactgcctcaaaagacatgggtgtggaggcaggctcgctgaatgttaccaataccaatctgcgtaccaactcgggtaatctgcacattcaggcagccaaaggcaatattcagcttcgcaataccaagctgaacgcagccaaggctctcgaaaccaccgcattgcagggcaatatcgtttcagacggccttcatgctgtttctgcagacggtcatgtatccttattggccaacggtaatgccgactttaccggtcacaataccctgacagccaaggccgatgtcaatgcaggatcggttggtaaaggccgtctgaaagcagacaataccaatatcacttcatcttcaggagatattacgttggttgccggcaacggtattcagcttggtgacggaaaacaacgcaattcaatcaacggaaaacacatcagcatcaaaaacaacggtggtaatgccgacttaaaaaaccttaacgtccatgccaaaagcggggcattgaacattcattccgaccgggcattgagcatagaaaataccaagctggagtctacccataatacgcatcttaatgcacaacacgagcgggtaacgctcaaccaagtagatgcctacgcacaccgtcatctaagcattaccggcagccagatttggcaaaacgacaaactgccttctgccaacaagctggtggctaacggtgtattggcactcaatgcgcgctattcccaaattgccgacaacaccacgctgagagcgggtgcaatcaaccttactgccggtaccgccctagtcaagcgcggcaacatcaattggagtaccgtttcgaccaaaactttggaagataatgccgaattaaaaccattggccggacggctgaatattgaagcaggtagcggcacattaaccatcgaacctgccaaccgcatcagtgcgcataccgacctgagcatcaaaacaggcggaaaattgctgttgtctgcaaaaggaggaaatgcaggtgcgcctagtgctcaagtttcctcattggaagcaaaaggcaatatccgtctggttacaggagaaacagatttaagaggttctaaaattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaatattgacttgatttccgcacaaggcatcgaaatcagcggttccgatattaccgcttccaaaaaactgaaccttcacgccgcaggcgtattgccaaaggcagcagattcagaggcggctgctattctgattgacggcataaccgaccaatatgaaattggcaagcccacctacaagagtcactacgacaaagctgctctgaacaagccttcacgtttgaccggacgtacaggggtaagtattcatgcagctgcggcactcgatgatgcacgtattattatcggtgcatccgaaatcaaagctccctcaggcagcatagacatcaaagcccatagtgatattgtactggaggctggacaaaacgatgcctataccttcttaaaaaccaaaggtaaaagcggcaaaatcatcagaaaaaccaagtttaccagcacccgcgaccacctgattatgccagcccccgtcgagctgaccgccaacggcataacgcttcaggcaggcggcaacatcgaagctaataccacccgcttcaatgcccctgcaggtaaagttaccctggttgcgggtgaagagctgcaactgctggcagaagaaggcatccacaagcacgagttggatgtccaaaaaagccgccgctttatcggcatcaaggtaggcaagagcaattacagtaaaaacgaactgaacgaaaccaaattgcctgtccgcgtcgtcgcccaaactgcagccacccgttcaggctgggataccgtgctcgaaggtaccgaattcaaaaccacgctggccggtgcggacattcaggcaggtgtaggcgaaaaagcccgtgccgatgcgaaaattatcctcaaaggcattgtgaaccgtatccagtcggaagaaaaattagaaaccaactcaaccgtatggcagaaacaggccggacgcggcagcactatcgaaacgctgaaactgcccagcttcgaaagccctactccgcccaaactgaccgcccccggtggctatatcgtcgacattccgaaaggcaatttgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaaggtaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggccaagcaggctataccaacccagacagttaaagaacttgatggcttactacaagaatcaaaaaatataggtgctgtaaatacacgaattaatatagcgaatagtactactcgatatacaccaatgagacaaacgggacaaccggtatctgctggctttgagcatgttcttgaggggcacttccataggcctattgcgaataaccgttcagtttttaccatctccccaaatgaattgaaggttatacttcaaagtaataaagtagtttcttctcccgtatcgatgactcctgatggccaatatatgcggactgtcgatgtaggaaaagttattggtactacttctattaaagaaggtggacaacccacaactacaattaaagtatttacagataagtcaggaaatttgattactacatacccagtaaaaggaaactaactaaatatgagtaactttgaaaaaaaatatattttagaattaaatgatgctttaagccatttaaatcataactctacctcatttgatttattgaaagttttgatttcatggttatcaaacgatattgtcattgataaatttaaaattttaggttatgactttagtaaatatatcgaaatgaatcccgatgactatccggttgaaaaatctatattgaatagagaggaaattatttatctcaaaaacaatatttatcgtaaaatatcatcaggaaattttaaatttcaatactttgtacaatatattagagatattttagaatatttatttattgaacatattgaaagagtctgtccttactgcgaatggggtgaaatgcaaaaattagaagaacaaaatacgcatgaaacggtgtatctctgtactcaatgtggatgtgctttttataacgataattcacaatttttattaaaaacccctttaaccattccaatgaaacgtgatgaatttaaataaacaagccgtagcctgcatgaaccctaaaatccacgtgtagcgtgtgtgcgccagcacgcatgcgttccatgatttacggctcaatgccgtctgaaaagctcacaatttttcagacggcatttgttatgcaagtaaatattcagattccctgtatgctgtacagacgcgggagtgttaagccccccttgtttgaagctccgcggctcctgccgagcttcaccgaccccgttgtgcccaagctctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaataggaaattttatggaaacattgaatgatataaaaaaaatcttgattaatgtggggctttatcaagggtttgatttgacagatccaaaagtatcagaagaagttaatcatgaaacagctaatatgaaatggattaaagattatacttcagacgggaattgggataatgaatttaaggaggatttaaaaaactttttagattatatggaagtatgccaattagccctaaacgataaaaatttcaaaattgccagtaattctttatttatggctatgatttacgcaggtaatctatctcttatatttgattcaataaaaactgatatatcaacattattgagtgctgagtataaaaagaatagtttttcatggccatctcttgatgaatagaaagcaagttgtagcctgcatgaaatctaaaacccatgcataaggtgtgggcttcagtatacgcgttccatgatttacggccatatgccgtctgaaaagctcaattttttcagacggcatttgttatgaaagtaaatatttagattccctgtatactgtttagactcgtgtgtgctgagtaagctgtagtctgcatgaaacctaaaactcgctcaaaattaagctaagacattagcagggcaagggcgaaaattgaatcttaaataaggtgattcagatgaaaaattttaatgtagtaaaagaaagtttaagagagttaggaattaaacaaggatttgatctttatgagaaagccacaactgaaaaattgaatagtgaagatcctcttgacttacaatggctttctaactattcatctgattggaatgatgaattagaagaagactttgattctttttttcagcatatgaaggaatatcaatatgctattgacaatgaagacattaaatctgcatgtagttcactatgtgaagctatgctctatgttggtaatattaaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggtgcgataggtgcggctgtgggcgagatagtcggggaggctttgacaaacggcaaaaatcctgacactttgacagctaaagaacgcgaacagattttggcatacagcaaactggttgccggtacggtaagcggtgtggtcggcggcgatgtaaatgcggcggcgaatgcggctgaggtagcggtgaaaaataatcagcttagcgacaaagagggtagagaatttgataacgaaatgactgcatgcgccaaacagaataatcctcaactgtgcagaaaaaatactgtaaaaaagtatcaaaatgttgctgataaaagacttgctgcttcgattgcaatatgtacggatatatcccgtagtactgaatgtagaacaatcagaaaacaacatttgatcgatagtagaagccttcattcatcttgggaagcaggtctaattggtaaagatgatgaatggtataaattattcagcaaatcttacacccaagcagatttggctttacagtcttatcatttgaatactgctgctaaatcttggcttcaatcgggcaatacaaagcctttatccgaatggatgtccgaccaaggttatacacttatttcaggagttaatcctagattcattccaataccaagagggtttgtaaaacaaaatacacctattactaatgtcaaatacccggaaggcatcagtttcgatacaaacctaaaaagacatctggcaaatgctgatggttttagtcaaaaacagggcattaaaggagcccataaccgcaccaattttatggcagaactaaattcacgaggaggacgcgtaaaatctgaaacccaaactgatattgaaggcattacccgaattaaatatgagattcctacactagacaggacaggtaaacctgatggtggatttaaggaaatttcaagtataaaaactgtttataatcctaaaaaattttctgatgataaaatacttcaaatggctcaaaatgctgcttcacaaggatattcaaaagcctctaaaattgctcaaaatgaaagaactaaatcaatatcggaaagaaaaaatgtcattcaattctcagaaacctttgacggaatcaaatttagatcatattttgatgtaaatacaggaagaattacaaacattcacccagaataatttaaaggaaaaattatgaaaaataatatttttctaaacttaaataaaaaatctataaataacaaccattttgttatttcgattttttttgaaacaatttaccaatttgaaactaaagatacgcttttagagtgttttaaaaatattacaactaccggacattttggagtaataggtgctcaatatgaaaaaatagatgctaccagatggattggagattatgaagaggtaaatggatttgagtatattgataaagctccttctatttatttttcagttggagatgatttcaatcctgaagaattaattatacctattaatttagcatatcattactttaatattgcaatatctgatttcttaatagctcaccctgaatatcaaaaaaagtgtaaagaaatacaaaaaacatattctcaaacaaactgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagacgcgtgcgtgctgaagacaccccctacgcttgctgcagaactttcgggtaaaaccggtgtgagcattagcgcaccgtatgccaatgagaacagtcgcatcctgctcagcaccacggatatcagttcggaaaacggcaaaatcaaaattcaatcttacggtgaccaatattactatgcgagacagagcgaactctatacctttgaacgccgcagctacaaaactggcaaatggtacaaccgcaaacacattaccgaagtcaaagaacacaaaaacgccaagcccgacgcagtaaccctcagcgcatcccaaggcatcgacatcaaatctggtggcagcatcgacgcctacgccaccgcattcgatgcccccaaaggcagcattaacatcgaagccgggcggaaattgacactctatgccgtagaagagctcaactacgacaaacttgacagccaaaaaaggcgcagatttctcggcatcagctacagcaaagcacacgacaccaccacccaagtcatgaaaaccgcgctgccctcaagggtagttgcagaatctgccaatctgcaatcaggttgggataccaaactgcaaggcacacagtttgaaaccacactgggtggcgcaaccatacgcgcaggcgtaggcgagcaggcacgggccgatgccaagattatcctcgaagggatcaaaagcagcatccacacagaaaccgtgagcagcagcaaatctactctatggcaaaaacaggcaggacggggcagtaacatcgaaaccttgcaattgccgagtttcaccggtcccgttgcgcccgtactgtccgcacccggcggttacattgtcgatattccgaaaggcaatctgaaaacccaaatcgaaaccctcaccaagcagcccgagtatgcttatttgaaacaacttcaagttgcgaaaaacatcaactggaatcaggtgcagcttgcttacgataaatgggactacaaacaggagggcatgacacccgcagcagcagctgtcgtcgttatcgtcgtaaccgtattgacctacggcgcactgtccgccccggcagccgccggaacggcgggcgcggcaggcgcaggagcgggaggagccgcagcaggaacggcagccggaactggagtagcagcaggaacggcagccacaaccggagtagcagcaggcacatcagctgcagctatcaccacagccgcaggcaaagccgcactggccagtctcgccagccaagccgcagtttccctcatcaacaacaaaggagacataaaccataccctgaaagaactgggcaaaagcagcaccgtcagacaggccgccaccgccgccgtaaccgcaggcgtactgcagggcataagcgggctgaacacccaagcagccgaagccgtcagcaaacattttcacagtcccgcagcaggcaaactgaccgctaacctgatcaacagcaccgctgccgcaagtgtccataccgccatcaacggcggcagcctgaaagacaacttgggcgatgccgcactgggtgcgatagtcagtaccgtacacggagaagtagcgagcaaaatcaaatttaatctcagcgaagactacattgcccacaagatagcccatgccgtagcaggctgtgcatcggcggtagcaaataaaggcaaatgtcgggacggcgcaatcggcgcggcagtcggcgagatggtgggagaaaccctgttggacggacgcgatgtaggcaaactgtcaccccaagaacgccaaaaagtcatagcctactcgcagattatcgcaggcagcgcagtggcattggttaaaggggatgtgaatacggcggcgaatgcggctactgtggcagtggagaataatagtcttttagctcgcaggagggtaaatatacgttggacttcgcgacaagaattggaacatgaatatgccattcttgaaatccaggccattaccaatcaaatccgaaggctggatccgaaatttaacgggattgctattatgaggaatcctagagagccgtggacaagacatgatgtacaaacatacaggcaatattataatcaattaagggaatccagaggctttgctgttgacccaatttatagaatcaggataaacaacggcaatgaatttaaccgtatcatgtcatcaaaatacccttataatgagctttatgtagccaatcctaaatcggcgacggggtattttagggtagattcgtataatcctgcgacagaggaaattatttcaagaaaatttacccaattttctcaaatccaagaaagtacggggattggttatatcaaggaggctgttagaaaatatagccctggtgctgtcatttccaatgttccaagtacacctactacgataagaggaagaaagcttgaaggaaaacttattttagaagttcctgctcaggtcaatccaattccacaatctgtattaagggcggcacaagaagaaaatgttatcattagagatacaacaggaaggatttacaaatgaagaaagatattttttattgtgagcagtggtcttatggttataagaaacttcataagcctttttctgagaaacaagctgaggaaaaacatcttaaaggggagttatatactgccgtaataggttcggcgacacaacctgaatatgtaattaccttgcgagaggaagtaggttttttttcggtacattttttcgataaatttggaagggattatttaacccatcaatttcaaaaatattccaattcgaattattattttctttctatggctgtatggagagattatataactttggaatctcatgacttagcagaaggatatacttatttcttcaatgaaaatacggatgattgctatgttttgaaagaggattttattaataatgagcgatatgaaaaaacagaattatattcccaaaaagataaggtaattctatttccaaagtttggcgaatatgatttggtgttaaatccggacattatttaattgagttttaaggccgtctgaaaaaatttcagacggcttttattattgggtttggaatctgaggataaagctgataaaaaccaggaaattatcaggttgctatatacgtattgttgtacagactaaaggcagcaatcaaatcactactgcttacccacaaaaataaatcgattatatggagtaatcatgaataagagaatgaaaatgtgtcctgcttgtcaacaaggctatctctaccattcgaaacctaaatatcttcatgatgaaattattctgtgtgatgaatgcgatgcagtatggctcaaaggtatgaatatattttatggagaatatgaaaaagatttttattcttatgttcctttcatggaatcccaaggtataacgagtgaatgtatttgggaaggagatttgtttgatcatccatattatgaagatgaaaactcaaatgatatggattgatggaaattttaagcctgcgtaggtacgattagccatcaaacggcgtaatcatacgcaagattatcaacagagagggctggcagcgatataccacccacaagattgcccatgccatagcgggctgtgcggcagcggcggcgaataagggcaagtgtcaggacggcgcgattggtgcggtcgtgggggagattgtcggggaggctttggttaagaataccgatttcagcggtatgactgcttctgaaattgaaaaagctaaagcgaatattactgcgtatgcaaaattggtagccggagcgactgtaggtgttacaggaggcaatgttgatgtggcggcaaatgcttccgaaacagctgttaaaaataatgcattagatattatttgggatattggcaacctcgtatgggacggcggtaaatggatttacgccaaatctattggcgataagcagatggctcgagaagcggcgattgattttggtgtggatgccgccgcagctgccgttccctttgttccggcaggtgcgactaaaatcagccgaggcggggcttatgttctgaaggcgggagacgaagcagttgatacggctaaagccatacaggaaattcagaagcagaccggaatcaagcttacttatgataaggttaataaggtttggacaacaccggcggggttagattatgggttagatgctaagcatggtaataggattaaacatgttttagcccatacaattccaaatccaaacaaacctgttcattctgtttttaatgtgtcccgtaaagaagttttgcctttggttgatgaagcttggagaatgaaaggaaatcctttgccaaatgattcatccgtatatcttgtagatatgaagaaacctattggaacaaaaggagaaacaaaagtgcggattgttgtgcaaaaaggaacaaataaaatcatttctgcatatcctcagaaataattaagaaaggaatctcttatggataaagaaattaaaatttgcccaagatgtgagcaaggctacctttatcatgcaaagcctaaatatttctctggggaggtcattttatgcgatgaatgttatgctatgtggcttggggatatgaaaattttttacggacaatatggaaaagatttttatgattatcatgagtttatgaaagataaaggcatagaagaaataaatatgtgggaaggagagctttttgatcacccatattatgaggatgaaaaatttaaataattgattttctgttccccgaatttgggaaatacgatgatattttaaacccaaatattatttaaagtagcaataggccgtctgaatatccgtttttcagacggcctcaatgcaactgctggcagccgaaggcattcaccaacaccaattgaatgttcagaaaagtacccgtttcatcggcatcaaagtgggtaaaagcaattacagcaaaaacgagctgaacgaaaccaaactgcccgtacgcgttatcgcccaaacagccaaaacccgttccggctgggataccgtactcgaaggcaccgaattcaaaaccaccctttccggagccgacatacaggcaggggtgggtgaaaaagcccgagccgatgcgaaaattatcctaaaaggcatcgttaaccgcatccaaaccgaagaaaagctggaatccaactcgaccgtatggcaaaagcaggccggaagcggcagcacggttgaaacgctgaagctaccgagctttgaagggccggcactgcctaagctgaccgctcccggcggctatatcgccgacatccccaaaggcaacctcaaaaccgaaatcgaaaagctggccaaacagcccgaatatgcctatctgaaacagcttcagacggtcaaggacgtgaactggaaccaagtacagctcgcttacgacaaatgggactataaacaggaaggcctaaccggagccggagccgcaattatcgcactggccgttaccgtggtcacctcaggcgcaggaaccggagccgtattgggattaaacggtgcggccgccgccgcaaccgatgcagcatttgcctctttggccagccaggcttccgtatcgttcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaggcagcaagtaaaatcaaacagttggatcagcactacattgcccataagattgcccatgccatagcgggctgtgcggcagcggcggcgaataagggcaagtgtcaagatggtgcgatcggtgcggcggtcggtgaaatccttggcgaaaccctactggacggcagagaccctggcagcctgaatgtgaaggacagggcaaaaatcattgctaaggcgaagctggcagcaggggcggttgcggcgttgagtaagggggatgtgagtacggcggcgaatgcggctgctgtggcggtagagaataattctttaaatgatatacaggatcgtttgttgagtggaaattatgctttatgtatgagtgcaggaggagcagaaagcttttgtgagtcttatcgaccactgggcttgccacactttgtaagtgtttcaggagaaatgaaattacctaataaattcgggaatcgtatggttaatggaaaattaattattaacactagaaatggcaatgtatatttctctgtaggtaaaatatggagtactgtaaaatcaacaaaatcaaatataagtggggtatctgtcggttgggttttaaatgtttcccctaatgattatttaaaagaagcatctatgaatgatttcagaaatagtaatcaaaataaagcctatgcagaaatgatttcccagactttggtaggtgagagtgttggtggtagtctttgtctgacaagagcctgcttttcggtaagttcaacaatatctaaatctaaatctccttttaaagattcaaaaattattggggaaatcggtttgggaagtggtgttgctgcaggagtagaaaaaacaatatacataggtaacataaaagatattgataaatttattagtgcaaacataaaaaaataggagttagtatgaaatatatgattagttttctaaaaaaaacatttgaattaatgagttgggtgttagtcatactaataattgggacattttatgactattatcaaataaggcaatatgctgaattagaaaagaaatctatatcaaatatcttgctatatgcccaaaaagaaaaatttcgcttagagagtaaagataaatacatgcgaggaggatatacaaaatataaatttattttttcagaatatagtaatactacttttttaaatttcataaatgacctgaaaaaagataattatttaccacttgacggctatggacatggttttctatgtagaaaaggagagtctatatcaatcaatatataccctgaaattaataaatttattttagtatggggataccctgaaaatctttgcgctgattctaattaagtaagcaagaataggttatagggaaataaaattcaaatgagaaaattgaataatcacgatgttcataaacggtatcaagatcgtttagaagaggatgtagagttcactatcaactatgagcttcctttgagttgtttgtggtcaaccatcaaagacttttccagcgattttgaggaaaaaactgaagcgttctttattcttttcaaagagctgctgcgcagaggtcatctgaaactgcaacgcgacgggcaaattatcgggcatacgcccgaagaatgggaacaaatatttagggaagtatggcctgaatatgaaatcgaacccaatccacttcccggctatgccccatttgatattggaatgtggcttacggtcgaggctcctgcctacgccgtatggatagatcccgaagacggtagcgaatactgggcgggataaaataccaatgtttggaataaatcccgtctgaaaaacagctttttcagacaggatttattccaattatcggtgatatacagagttttgtacaagcacagaccgctgccgatcacctgtttgctttgctgggtgtggttccgggtatcggtgaatcgatacaggcctataaagtagcgaaagcggcaaaaaatttacaaggcatgaaaaaagccttggacaaggcagcaaccgttgccactgcacagggctatgtcagtaaaaccaaaatcaaaatcggtcaaactgaattaagggttactgcagcaactgacaaacaattgctgaaagctattggcgaaggaaggacacgacaggtaaaatgaccgagcagttatttgactctttagctaaacaaaatggcttcagagtgctttcgggcggcaaatacggcggaaataacggttttgatcatgtatggcaggctgccgatggtagtgttgttttgattgtagaaagtaagcagattaggaacggtacggtacagctgaatccgaatggtgcgggtggatatacgcagatgagtcgtgaatggattaaacaagttgtaaaaagtttacctgatggtagtcctgctaaggcagttgtcttaaaagcaaatcagaacggcaaattaaaaacggcaatagcaggcgttgatcgtcaaacaggtaaggccgttattctttctgtcaaagttccttctaaaaccaatataaggagataacaatggggcacaatatgatgaccacccaaaaatggtatgaacatattactaatgtaatcataggcaatactgctaatttcaatagcggttgccccgaatctatagattatgtagatgaaaaaaaaggcgtgccgcttgcagcgatgaaatacattttaatgtacactgaagctgcggcttcccatgcctatctatttgaacatgatcttaagaaattcaagcaatatgcttatgttgcaggaaagttgggtattttgcagagtgtagatgatgaagaccccgaacccttcttctttccctgcgacatgctcaacattcaagatccgatgtttctgatgctgatgagcgacagcccgcagctgcgcgagtttttggtgcgcaatatcgacaacatcgccaacgatacagaagccttcgtaaaccgatacgacctcaaccgtcatatgatttacaatactctgctgatggtggagggtaagcagcttgatcggttgaaacaacgtagcgagaaagtcttggcgcatcccacccctagcaaatggctgcaaaagcggttgtacgattaccgcttcttcctcgctttcgccgaacaggatgccgaggcgatgaaggccgccttagagccgctttttgataaaaaaaccgcgcgtatggctgccaaagaaacattgtcctatttcgatttctacctgcagccgcaaatcgttacctacgccaaaatcgcatccatgcacggtttcgatttgggcatagaccacgaaatcgcgccgagggatttgactgtttacgatccgctgccggcagacgaatatcaagacatcttcgattttatgaaacagtatgacttgtcttatccgtatgaatatctgcaggattggatagattactatacgttcaaaaccgataagctggtatttggtaacgcgaagcgagagtgagccgtaaaactctgagctcctgttttatagattacaactttaggccgtcttaaagctgaaagattttcgaaagctataaattgaagcccttccatagtacatagatctgtgttgtggcgaggctttaccacgctgattgccggagaagaactcaacctgctggcaaaacaaggcatgagatctttgcaataacatgagttgagacctttgcaaaaaagcccttccccgacatccgaaacccaaacacaggatttcggctgttttcgtaccaaatacctcctaattttacccaaatatccccttaatcctccccggatacccgataatcaggcatccgggctgccttttaggcggcgcgggcgcacttagcctgttggcggccttcaacaggttgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaggttcaaacacatcgccttcaggtggtttgcgtactcactttgtcatttccaatgttccaagtacacctgctccgctaagaggaagaaaacttacaggaaaacttattttagaagttcctgctcaggtcaatccaattccacaatctgtattaagggcggcacgagaagaaaatgttatcattagagatacaacaggaaggatttacaataggtggtggtttagtattaggtggttgtgcaggtgcacatcttgcaagaaaagaaccattgatactaacagggaaaacaggggcaggtgcgtcagcaattgcaaatgcaagcattggatatcaatggactgtcaatttgtcaaagccaaaagaaggagctaaataataatgcattcccactatatatttggtattttgatgatttcatatgttttcgcaatgttatttaattttataatatcatataaaatatttaaagaagaaaaattaattaatggtttttttgattttctaattaaatcaagctaccttaactttaaatatttcaatatattatttggaaaataaaaaatctcaaatattttttatttgaaattattaagaattaatctggcgttgggggtttttatcttatccttaataattataaatattttttgtttttagtaaaaatatggtacagatatgtacagctagctttgtttcagtaaggtataactgtatataatactcagatttttcacgttgggctatacatggaaatatatctgtgattaaagatgttaatggtaagtatcgattagcacctgaaaagcatgattttaaaatgcattcctttggggggagaaaaaagtaatgtaaaaacaatatttagaaatatggaaactataattggtagcccagggtaaggggtacctttcaggattgaatttaaaggagaggtaaatattgttaactaagttgaaaattttgctatttttgttcttatttgtttttgtattggctattaatttgcttttcttcttttttagttcggatatcgagagtttcgggaactatcagtttgaatatgtttacgataaaggttggcctgctaattatattttagtcatgaaagatggaaatgaagggaattttgataaaataatatccggattggttttagaatattataaggaggatgataacatttatttttcttatattgacgggcaaggatttgcttcagactcttgctattacaaaccggaaattttatatggaaaaattattttaaataaaaatcatatcattaatattaatagcatggaaaaaaataattttctttcagaagataaaataatgaagggaacaagaaattggctagcagaccctaaaaataaatgtaatatacagactctagactaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtgggatttagggctaatctagtacagccccttgttttttcgatacggaaccggatagaggaaaaatcgaacattgcgcctgccttgctatgattcacgaagaaatctccgccatgcctatgggctatgaaaccttgatcggcgatatgggcagcgcactgtcaggcggacaaaaacaacgcatcgtattggcgcgggccttaatattgcgaaccgaaaatcctatttttagatgcagcgaccagccatttggatattgccaatgaaaaagcagtcaatgcaaacttgaatggcttgtctatcataaaaattatggcggcacacagaaaggaaacggtggaatcagcagataggaaaatgtctttaggataaaaatacagtttcaaaaatactcaagactactgccgttttttcgcctgagcgtcaaactctgccagcgtcatgttcaaagtctgcaaacacggtgtcattaccgcatcgacagcttggttcacatgatccctttccacaggcaacggacggtaaacgaagagcttgaagagttcgttcaactcaatcgaatccgcccccgttttcaacacccaaccctgtctgccggaatagatgtagccgtgccgcgccagcttttccaaaagctcgcccaactcgtcgtagcccatattgatatgccgtctgaactcctgaacaggcaaggctttgccttctttttgcgccgcatccagaagcagcaggattttcaacacgtcgtcaaaccgtccgcgcgagtcgaagcccctgcggaacgcttctccctgccagtaggagagtgaagaagtcagcaccgcgccgcccaagaccagcgtccacaacaggttcagccacaacagaaaaaacggcacggcggcaaacgcgccgtaaatcgagcggtagccgtcgaaattgcccatataccaagtgaagagggagcgcgcggtttccagacaaaacgctgttgccaaagccccgacaaacgcctgccgcgcgggaacgaagcggtttggcacgaagcggtacagcccccacagcaaaagcgtcatgaaggtcagcgtcgccgccgttcgcaacgcgcccgaccactgcggcgcacctgaggcaagcgcggcatcctgtaccgagccgaccataaaggaaatgcccacgcccaaagacagcggcccgaacgtcagtaaagcccaatagacgagaaactgcatcatccacggacgctgggaattgacccgccagatgcggttgaacgtattgtctatcgtccgaatcagcatcagcgaggtaacgaccagcatcacgctgccgattgccgtcagccggttcgcctgctcgcggaacgcattgatatagtcgaacaccatgtccgcgccctgcggcacaatggtttggttgacgaaggagacgaacgaatccgaccagcggtcgaacacggggaaaatcgaagcgaccgccaccatcacggtcagcacggggacgagtgccagcagcgtcgtaaacgtcatgcttgccgccgcctgcggtacgcgttcttcatcaaagcggcggacgacgaaccatgcaaacgcacagattttattgtctgccaaaccttgcaaacgttgtaaaaaggtcataatttcttgcccggtcagtaagttgggcattgatgcccgatgttatagccaattttgccgtcaggaacaaatgcctgaactgcggctgtttcagacggcatcggaacaactgttatgccgtctgaagaccgaaccattttaacggaatccgcccatgaacccaaatccccctcaaaatcctcgtcctctactatttccaaaacggcagcacccgcaatcccgcactccgaatcgctcgcggcatcgacagcgttgaaggttgcgaagccgtattgcgcaccgtccccaaagtctccgccgtctgcgaagccgtcaaaaaagatattcccgacagcggctcccgtcctgaccgccgaagaaaacaatatcgccttcgcacaaagcaaacgcttggcggaactcgccgtcaagtcggcataagccgcgtgttcagacggcatggcgttcagatgccgtctgaacacgtttgcctgtataatccgcatctttactgtccaacttcgcggttcgcaaacctcccgcgttaccaaaactaggattcgatatgtcaaaccaacaagccttggtcatcttttcgggcggtcaggattcgaccacctgcctgattcaggcaatccaaacctacgggcgcgaaaacgtccaagccattactttccaatacgggcaacgccatgccgtcgagctggaacgtgcccgctggattgcgcaggatttgggcgtcaaacaaaccgtactcgacttgagcctgatgcggcagattacgcacaatgccctgatggacgacaccgccgccatcgaaactgccgaaaacggcgttccgaatacctttgtagacggccgcaacgcgcttttcctgctctatgccgcgatttacgccaaagggcaggggatacggcacatcatcgcgggcgtgtgcgaaaccgacttctccggctatcccgactgccgcgacgtgtttgtcaaatcgatgaacgttacccttaatttggcgatggactatgattttcaaatccacacgccgctgatgtatctgaccaaggcgcaaacgtgggcgttggcggacgaaatgggcgtgctggactatatccgcgagcaaacccacacctgctataacggcatcgtcggcggctgccgcgaatgcccgagctgtatcttgcgcgaacgcgggctggcggaatatctggaaagtaaaaaggccgtctgaacacgcgcaaaccataaggaatacgatatgcccaagctccatatgttttacctcggcggcaatgccggcaggtcgaatatcgaagtgcacgacatccaatttgccgtgtgcgacaactaccgcgaggccgtccccgcgctcaaagccgcgtggttcggcgatgcggacaaaatccacatcgacggctggcagattgtcgaatgggcggacggttacgacatcgccgtatccgaaacgcccaaaacgaaaatgccgtctgaacacgccccgcgcctgtatttcgccaatgtcggcggttatcgcgcgggtcagcttgccgaggcacacgctttcgggctgttcgccgccgccacgcctgccgaagccaaacaaaaagccctgcaaaccctgttgaccgacagctatgttcagcagcataaagacaacttaaaagacgtggacaacctgcttgcgctcgaccgcatcggcaatttccatatccgcctgaccccgaatccgcacggcaaacccgccgaaatcggctttcaaggctatttgcccatttgagaacccatgaaaatcaccaaaatcttcaccttcgactcctcgcatatgctcgacgggcatgacggcaaatgccaaaacctgcacggacatacctacaaactcgaaatcaccgtttcagacggcattatcaaaggcggcgcgaaagacggtatggtgatggactttaccgacttgaaagccattgtcaaacaacacattaccgaccccttcgaccacgccttcatctaccacggcggcaacagccgcgaatgccaaatcgccgcgcttttggagggctggaacatgaaaaccctgcgcctgccctgccgcaccactgccgaaaatatggcggtcgaaatgtacggccgtctgaaaaacgcggggctgaacgtgtgccgcgtgaaattgtgggaaacgccgacatcgtgtgcggagtatgaaggggagtagggaatatcttgaacgtatcgatatagtaaattccaataagacatgcccaaccgcgtcattcccgcgcaggcgggaatccagaccttgatttatcaggaatatttaaaaattgcagcaattccaactctctggattcccgcctgcgcggaaaggacggtttagagcgtccttatttgaatttaccgtaaaacggttttttctcctgtacggattccccgttttttcagacgaccttccatatcaaatacacccattaaaaggaatacccatgaaactcctcttcatcctcctagtcctcttcgtcgccgtcgaacatttctacatcgcctggcttgaaatgacacagattcccagcgaaaaagcggcggaaatattcaagctgccttatgaatttatggaacaaaagcaagtgcagaccttgttcagtaatcaagggctgtataacggctttctcggcatcgggctggtgtggtcgcggtttgccgcgccggacaacgccgtttacggcgcgacgactctgtttctcggtttcgtattgattgccgccgcgtggggcgcgttttcgtccggcaacaaaggcatactcgtcaaacaaggactgcccgcgatgctggcggcggcagcggtgttggcggtatgaaaaaaatcaatgttgcccccgaaaatccgcaataccgtatcgtcgaaattttcgagagcctgcaaggcgaaggctggaacacgggcatgcccgccgttttcgtccgcttgggcaaatgcaatctggcgtgcggctggtgtgataccgattatttgacattcggtatgatgggcttgtccgatatcttaggccgtctgaaaacctacgccgcccgcaacatcatcatcaccggcggcgagccgaccatacagccgcatctcgatatgctgctggacacgctcaaggcggaaggctatttcctctgtctcgaaaccaacggactcaatcccgcgccgccgcaaatcgactacgtcgccaccagccccaaagcctgctacgccgccaaatatgaaaatagctgtatcgaaacagccgacgaagtgcggattgttgccgatggtgatgtccttgcgttctgcgaaaacatggaacgcaaaatccgcgcacatcattactacctttcgccctgtgagcaagacggtgcgatgaacatctacgacaccatccgccaaatcggtattttaaacagtcgccccgacgcatccgtgcattggcagttgagcgtgcagacgcacaaatgggcgggaatagagtagtttaagcagtgtaactcaaagggacggcgtacggttttaccgatgtttgacatacggggaaagtgtgccgcttctgcgtggaaatgccggcatttccaccgcccaatcaggacggagccttactgaataagatgctgccgttgggtacaagctcggcttcctaaattccgatggtcttttgaaccttgccgatactctgtgccagtgcgcgcaaatggcagggttagggaaaacgaaatgccgtctgaaacagcattctgtttcagacggcatttttctgttgccgccaaaaggaaaaaccgcctcggcaatggatgccgaggcggtttgaatatggtcggaatgagaggattcgaacctccgcccccttcgtcccgaacgaagtgcgctaccgggctgcgctacattccgaattaagtaaggcgtgattatagcgcaaaaagtgcggcgtgcctataccgttttgcctttttgccgcgtgtcgggcggatttaaaacgttgtgtttgaatacagtgttgataatcatcattatctttaagtaattcaataagataactttctacctgaccgaaaaaatcattgcctttccctgacaaacggttgatgaaatcggcagattgttgaaacgcagccggtttaaaaggcttcgccgactttcacgccgcccgccgtgtcctgcggcgaggcaaggccggcaacaaaggcttgcgccgcttggaaatccgccgtctgcatcacggcttgcgcggcggcactgccgagcgtgttggccatatattgccaacgttgcgccaaagtgggattgtcaggaatgcggaaatcttcgcgcagttcatccacaaggtcgggacggttgcagacgaggacgatgtcgcaacctgcctcaaaggaaatgcgggcgcgttctttgatgccgcctgccccgcacgcgccctccatagtcaaatcgtccgagaaaatcacgcctttgaacccgatgtcgcggcgcaaaatttgtttgagccagatttcggaaaaccctgcgggctttgtgtccacttgtggataaacgacgtgggcgggcataaccgccgccataccttcgcggctcataatgcggaagggggcgaggtcggcggtttcgagttcggacaggctgcgccagtcttccggcaagaccagatggctgtctccttcgacaaatccgtgtccgggaaaatgtttgccgcaggatttcataccgccttttgtcaaacctttttgaagggcgagggcgaggcgggcgaccgcttcgggattgcggtggaaactgcggttgccgatgacggggcagtttccccagtccaaatctaagacgggcgtgaaggacaaatcgatgccgcaggcggaaagctcggttgccaaaacccggccgacttgtccggcggcggtttcggcggcggacgcgccgtctttgtcccaaatctcgccgagcgtactcattgcgggcaggcgggtgaagccttcgatgaaacgttgcaccctgccgccttcgtgatcgacggcgataatgagttcgggtgtgcgcagggctttgatttcggcggtgagtgttttgagttgttcgatgttttggaagttgcggcggaagaggatgatgccgcctacggcgggatcgagcaggcgttgcttttcctcttcggtcaggcggaaggcggcaatgtctgccatgacggggccgcgcggaatatgggggacggtcattgcggtttgctccaaaaagcttcagacggcatatgccgtctgaacagggaaaggggtcaggcgttggcgcgttttttatctttcaacagaaaaatcagcaccgccaatacaatgcctgtcgtgccaaagcccaacagcgcggattttgtcagacccaatgcgaggtagcccgatgcggcggcggcggcaacggttaaggcgtaaggcagttgcgaggtaacgtggtcgatgtggttgcagcgcgcgccggtggacgacaggatggtcgtgtcggaaatgggcgagcagtggtcgccgcataccgcccccgccattactgcggacatacacgggataatcagcgcgggttcgactttgaccgccatggcggcggcaatcggcagcataatgccgaacgtcccccagcttgtgcctgtggcaaacgccatcacgctggcgagcaggaagaggatgacgggcaggaagccgggatggatgttgcccgcaaccagtgtggagaggtaatcgccggtgtgcatttcgccgacaaccgtactgatgagccaagcgaggattaaaatggcgattgcgccgaacatagatttcgcaccctgccaaacggctttgggatagtcggcggttttaatcgtgccgagcgtgcagagaacgacggcaaggacgccgcaagtgccgccgaataccagcgaagtgtttacgtccgtgttttcaaatgcccccaaaatgctgaaggtttcgcttgcctgcgcgccggtgtagatcatggcggaaaccgttgaggcgattaaggccaaaacgggaataatcagtgcgtaaacacgacctttggtagcgtctgaaacggcagtttcatcgtgggcttcgttcaacgcggcttgttcgaaacgtgccatcgagccgatgtcgaaggaaaaccatgcgacgacgaacaccataatcagggcaaacagtgcgtaatagttcatcaggctcatggcgacaaacgtccccatcggcgtgtattcggtgattttgtaggtaacgagcagtccggcaagcgtggcgataatcgacgcgccccagcttgaaacgggcatcagcacgcacataggagcggcagtggagtcgaggatgtaggcgagtttggtgcgggaaactttaaacttgtcggtaacggggcgggcaatcgcaccgacggcgagactgtggaaatagtcgtcgataaaggttacgaacacgaggcaggcggtcagcattttcgcgccgcgccggtttttaatgtgccgttttgcccagtcggcaaacgcctgattgctgccggagtaggtcagcagggaagtaaaaatacccaaaagtatcaggaaaaccaagatttttggtttgcccagcgaccaatcgccgtctgaccaagccaagccgacgaccatgtctttcaggtgtgtcagaccgtcgacggggttgccgccgaccaaaaaggcaacgccgaccagaataccgatgcctaaagacagcagtacgcggcgggtaatgacggcaagtgccagtgccaaaaagggtggcacaaccgagaaaaatgaatgtgaatagtcgatcagctgcatggttatgggggtgttaagcgtccggatgggagcgtatctgtccgcctccggtttgggttttgttggcaaaatgggcggaaatattttttgtcgtaaaaaatatttgtttaaaatcaaccaactgatttttgtaaaatgcccgttaatcggtattgacgggcattttatcatttaaaaaatattttggttaaattatgtgtgttattgcaggtttaatgcgataaacagcgtgttgccacggcgcatgatcagcagggggacgtttttgcctgccttgtccatagctttgcggaaaccggcttcgtcattgacggggacttgcccgacggcaagaatttcgtcgccgcgcctcaagcctgcgcgttctgccgcgtcggaaacccgtacgacgacgaggtgtccgccgctgctgtcggtatgtgtctgaagggtaatgcctgcggattcgaccgagaacgtaccggattgctgttcggtgtagggggcttcatctgttttggatgatgcgccgatatgctcggcggcgttgcccagcttgactttgattgtgatttcttcgcctttgcgccatacgccgaggctgacttcttttcccggcgtaatggcgccgaccataacgggaaggtcgccggaagaacgtatttctccgccgtcgaggctgaggacgatgtcgcccgcctgcaggccggcacgttctgcggggctgccgggcaggattttggcaatcagtgcgccgccggctttgtccaaaccgaacgattgtgccaaaccgtaggatacttcttgaataatcacgcccagttgtccgcgttggactttgccggtgtttttcagctgttcggcgacattcatggcaacgtcaatcgggatggcgaaggaaatgcccatgaatccgccgctgcggctgtatatttgcgagttgatgccgacgacctgtccttttaagttgaacagcgggccgccggagttgcccggattgatggcaacgtcggtttggatgaagggtgtgtagctttcgttgggcaggcttctgcctttggcggacacgatgccggcggtcacgctgttgtcgaagccgaagggcgcgccgatggcggcgacccattcgcccggtttcaaatctttgggattgccgattttgacgacgggcagctcttccgttgcgtcgattttcagaagggcgacatcggattggacatccgaaccgatgagtttggcggtatattcgcgcttgtcgttgagcaggactttgatactgcccatgccggtaacgacgtgggtattggtcaggatgtagccgtctttgctgatgatgaagcccgaaccgaagttcaatccgccgtcatctgcttcttcttgggggatttcgggcatattcgggacgaggcgtttgaaaaattcgtagaacgggtcgttgtcggcaatcgggtcggaatcgttttcggcattgccgctgccgttttgggtgcgcggggcgggggctgcctgaatattgacgactgccggaccttcactttgaaccagttgggcaaagtcgggcagcagcatactgacgctgccgtcgtctttggtgtgttcgatgcgttctacgaaggatgcttcttttttgtccgcaccgaaaaagctgcctgccttgtcgcagcctgccagcgaggcggcacacagtgctgccaaagcgaggtattggtattttttgaacacgttttgtcctttgtcggatgccggtaccggctttaatgccgtctgaagcgcattttgtcggcttcagacggcataggttgaaattctacaacgtccgtccgaattttcaagcgtttcattttgaagggcggcggcggtcaggctttggcgggatattcgcacaaatcgttgatgatgcaggtttggcattgcggtttgagtgccttgcaggtgtagcgtccgtgcaaaatcagccagtggtgcgcgtccatcagaaattctttaggaatgaagcgcatcagtttgtcttcgacttcgcgcacatctttcccgggggcgattttggttcggttggatacgcggaaaatatgcgtatcgaccgccatgacgggatggccgaacgccgtgttcaatacgacgtttgccgttttgcgccccacacccggcaatgattccaaagcctcgcggtcttccggcacttcgccgttgtatttttccagcaggatgcggcaggtttgcataatgtgtttggatttggttttatacagcccgatggttttcgtgtattccatcacgccgtccaaacccaaatccagcatcgcctgcggcgtatcggcaacgggaaacagcttcgccgtcgccttgtttacgccgacatcggtcgcctgcgctgaaagcagaacggcaattaaaagctcgaaaggggagttgaaattcagctcggtggtcggatgggggttggcggcgcggaagcgttcgaagatttcttggcggatgtgtctgttcatttttttatacggtgggtttgtgtgttcggcattataacgtatggttcaggcggcgtaatattgcattccccacagaatgaaggcgtaacgcgccgttttgccgataaccagcatcagcccgcttgtccacggattcaaccgcagccagccggcggcaagcggcagtgcgtcgccgacgacgggcagccaggtaaacgcaagcagccaaataccgaaacgccgcatcagattcagtgttttttcagacggcatttttcgggagggcagcaaacgccccatccaataggaaaccatactgcccaatccgttggcaaggccggcgcacagcaacgcgccgtatgcgtgttcgggaaagcggtggacgaacagggcaaaggcggcttcggatgtgccgggcaggagggtggcggaagtgaatgcggaaaaggcgagggcggcgtaggtgtaggagggtatcattgcaaacagtctcaaacaggtaacaatcggcgacggattgtacggtatagtggattaacaaaaaccagtacggcgttgcctcgccttagctcaaagagaacgattctctaaggtgctgaagcaccgagtgaatcggttccgtactatttgtactgtctgcggcttcgtcgccttgtcctgatttttgttaatccactctattttcacgcccccgccgaagggcggaggacggtgcaaaaaatacggcacagccgtatgccccttttttgtcgggcatacgacattctttccgctccggttttgatgccacgatgcggcatttccgaattttccggatacggcggcggattttcattttattgggaacggtttttgcaagtccgccggaattttttaaaatctattaaaatctatgcaagcaactgtaaaatattaatttctgctgcttgaatttcagatcggcgcattgcctgcatccgataaagtttgcaaaatgttcaaatatcagtatgatttgcattgccgttaagaaatgtcaatttctattttcttgaaacgggtaatattccgacaccacgaaaggcaaatcatgtctgcgcaatcacaaaacaatcatacgtccccattggtcgtcttgaccacgctgttcttcatgatgggttttattacctgcatgaacgacatccttatccctcatttgaaagaaattttcgacctgtcttacgttcaggcgatgctgatccaattctgtttctttaccgcctatgcggtgatgtccatcccgatgggggcttttgtcggcaaagtcggctacaaaaacggcgttatcggcggctttctgctgacggcggtcggatgcctgctgttttatcctgctgcgggcagccattcttacgcggtatttttgggcgcgttgtttattttggcttccggcgtaacgctgcttcaggtcgccggtaatccttatgttaccctgctggcgaaacccggcaaggaatcggcaacactgacgctggttcaggcgtttaacgctttgggtacgaccattgcgccgcaaatcggcgcgttcctgattctggcggacgcaacccaaaccgtcagcaaggcggaacagatttcttccgtacagattccctatttgggactggcggggctgctgattatccttgccgttttcgtgaaaatgatccggctgcccgacgcgcgcaaaattgccgccgaggaaagcgcgcacaaccacgacggcaaaaccagcgtatggcaatacaaacatctcgtgttcggtacggcaggcattttctgctatgtcggcgcggaggtgtctatcggttcgttgatggtcaacgtattgggttatctgaaagggctggatcatgcttctgccgcgcattacctgtcgttctattggggcggcgcgatggtcggacgtttcctcggttcggcggtgatggcgaaattcgcgcccaaccgttatttggcgtttaacgcatcggctgcggtcgtactgcttgccgtcgcgatggcgacgggtagcggcaatgcggatgtggcgatgtggtcgctgcttgccatcggttttttcaactcgattatgtttccgacgattttctctttggcaaccaaaggattgggaaaatttaccaacgcggcttccggtgtactgtgtaccgcgattgtcggcggtgcggtcgttcctgtcgtgcagggctgggtggcagatacttacaccctgatgtcttcgtttgtcgtttccgtcatctgttatctgtatatcgtgttttttgcggtgtacggatatagggcggacaaataatctttttcttgagaaatgtcgtctgaacatctttcagacggcatttttgcgtaccggtgtttgcggcgtgtgtgccgaggttttaatacttcaatccataaaagtcttatatgtcaacaaacaaaaaaataaaaaattatatttcaaaaaaattaatttaaattgagaaaattgccgttttgtttctgtccggcttttgtaaaacgctaaaatgccgtctgaaaacgtcgggcggattcggtatggtgtgttagaatccgttaactttatatcaaatcgggcaaagaatcatgttcgctttcaaatccttactcgatatgccgcgcggtgaggcacttgccgtcgtcgtcgctctgattgccgcgatgggctataccatcatttcattggagtggttgccgcatatgtccattattgccgccatcgtcgtgctgattttgtacggcttggcgcgcggtttgaaatacaacgatatgcagcagggcatgataggcgcgttgaatcagggtatgggcgcgatttacctgtttttcttcatcgggctgatggtcagcgcgctgatgatgagcggcgcgattccgacgctgatgtattacggtttcggactgatttccccgacttatttttatttttcctccttcgcgctgtgttccgtcatcggcgtgtccatcggcagcagcctgaccacctgcgccactgtcggcgttgcctttatggggatggcggcggcgtttcaggccgatatggcgatgacggcgggcgcgattgtttcgggcgcattttttggcgacaaaatgtccccgctttcggatacgacgggtatttccgcgtccatcgtcggcatcgacttgtttgagcacatcaaaaatatgatgtacaccaccatccccgcgtggctcattagtgcggcactgatgctttggcttttgccgaatgtcgccgcgcaggatttgaacagcgtcgaatccttccgcagccagcttgaagccacgggattggtgcacggctattcgctgattccgtttgcgctgttggtcattttggcattgatgcgcatcaacgccgtcgtcgccatgctctttaccgtcatggttgccgttgctgtaacgtatctgcacagcacgcccgatctgcgtcagctcggtgcgtggttttacggcggctacaaactcgaaggcgaagcgtttaaagatgttgtcaaactgatttcgcgcggcggtttggaaagtatgtttttcacgcaaaccatcgtgattctcgggatgagtttgggcggactgttgtttgcgctcggtgtgattccttccctgttggaggccatccgtaccttcttgacgaatgccggacgcgcgacgttcagcgttgccatgacttcggtcggggttaatttcctgatcggcgagcaatatttgagtattttgttgtcgggtgaaacgttcaaacccgtttacgataagctcggtctgcattcgcgcaatctgtcgcggacgctggaagatgcggggacggtgattaacccgctcgtaccgtggagcgtatgcggcgtgttcatcagccacgcgctgggcgtgccggtttgggaatatctgccgtatgcctttttctgctatttgagtttggctttgaccctgttattcggttggacggggctgactttgagcaaaaaataagcggataagcgaaatgccgtctgaaacttgcaacggtttcagacggcatttttatgtttggcggatggggcggattgaaacagaaaacgcccgtaccgtcatcctaaactgtgcagaaacggcggtgcttacttcacgcgggtcgccatcagcgtatgcaggcggcggttgtcggcgcgtgcgacggtgaactgcaaaccgccgataaggactttttcgccgcgcacgggcagatgtcccaactcttgaatgaccaggccgccaatggtgtcggcttcttcgctgctgtattccgtgccgaagaaggtgttgatgtcttcgatttcggtagctgcatggatgcgccagcgttcggaagaaacggcatggatattgtcggcgctatcgtcttcgtcaaactcgtcttcgatttcgccgacgatttgctcgatgatgtcttcaaaggtgaccaagccggatgtgccgccgtattcgtcgatgacaatcgccatatggttgcgctgttcgcggaactcttttaaaagggcggtcagcgatttgccttcggggacgaagacggcggggcggagaatggatttgaggtggaactgctcggggttaaacatatatttgagcaggtctttggcgtgcaaaatgcccaaaacttcgtctttgtcttcgccgatgacggggaagcgcgaatgggcggtatcgataacgtaggcggtgatgcgctcgatgctgtcgttttcttttaaaacgttcatacggctgcgcgtaatcatcgcgtcgcgcacttccaaatcggaaaaatcgaggactttttccaatcttaaaagcgtatccgcatcaaaaacttcctgctcgtgcgcctgccgaagcaggtttaatacgtcttcggcggaatcgggttcgcgggcgagtcgggcaatcaggcgttcaaaaaaattcgttttcggttgtgcgccgtccattttaatgtcagtcctcttggtaggggttggggaagcctgccgcccgcatcaggcggatttcttcggcttccattatttcggcttcgtcgtcttcgatgtggtcgtagcccatcaggtgtaaagtaccgtgtatggtcaggtgggcaaaatgctgctcgggtgttttgccttgttcggcggcttctttcaaaaccacttgcgggcagataatcaaatcgccgtacagtttttccgaaacttggcagggcaggatttcgccttcgttgagcgcgaaactcaatacattggtggcgtaatctttgccgcggtagtcgcggttgtaggctcgggcttcttcttcgtccagaagaatcaggctgatgtcggcgcggcggtattcatttttcaaggcagaccacgcccagcggtagaaatcgcgttcggctgggatgccggcggcggaagaggcgttttcaaagttcaaatggaaacgttgccgctgcaacgttaagaaagggtattttttggtgcgtttcattgtggcgggtttcgtgttttgtgggtgtaaatataacatagacctgacggtgccgtctgaagaaacgttcaaaatatgatagacttcacgccgtttccattctttgaacgcattgaacatgaacccgaaaaaactcgtcatcgccagccgcgaaagcctgcttgctatgtggcaggcaaagcatatccaaggccgtctgaaggctctgtatcccgattgcgaagtcgagattttgggcatgaccacgcgcggcgatcagattttggacaaaactttgtcaaaagtcggcggtaaaggcttgtttgtcaaagagttggaacaggctttatatgacgggcgcgccgatttggcggtgcattcgattaaggacgtgccgatggatttgcctgaaggtttcgcgcttgccgccatcggcgaacgcgccaatccgtttgacgcgtttgtgtccaaccaatacacgcgtttggaagaaatgcccgaaggcgcggttgtcggcacatccagcctgcgccgcgaagcccagttgcgtgcgcgctatccgcatttgcttatcaaacctttgcgcggcaatgtgcaaacccgtttgtccaaactcgataacggcgaatacgacgcaattatcttggctgccgccggtttgcagcgtctgaaattggacggacgcatccgcatgattttgtcggaatccgacagcctgcctgccgccggacaaggcgcattgggtatcgaaattgccgcgcaccgcgaagatttgtatgaagttttgaaacccttgaaccacggtgttaccaatgcctgcgttaccgccgaacgcgccctcgcacgcgctttgggcggaagctgccaagtgcctttggccgcatattgcacggaagaaaacggcttgctgaccttgcgcggcttggtcggacaccccgacggttcggttgtgttgcgggcggacgcgcaagcccctgccgaatatgccgacgcgctcggacgcgctgtcgctaagaaattggcggacgacggtgcgcgggaattgattggagcagtattgaatacggaaaattgattttatcgaaaatttaaataaaataatataagttattgtttttaatcaatttgtttcatcagtttcactcgccttatttcgtcattcccgcgcaggcgggaatccagtttgctcggtttcagttgtttctaatcaattcttgcagcattggattcccggattcccgcctgcgcgggaatgacggcggaaaggtttttgtggcttcggataatactgtggcgttcaaattttgaatttgagaatgatgatattcgtattttttatttgagttcatcatatttggttgattttatagatgtttttagcttgtttgaaattgttatggtttattgttttttaacaaaaaacagatgccgtctgaactggttaaggttcggacggcattttcatatggctgtgctttttacagtactttcacgatgctttcgcacagataatcgatgttgttgtcggtaatgccggcgacgttgatgcggccggagcggacggcataaatggcaaactcgtttttcaggcggtcgacttgttcgggagtcaagccgctgaaagagaacataccgttttgtttgataatgaaatcaaagttttggcttgcacctttggctttgagcaacccgacaaatttttggcgcatggctttgatgcggccgcgcatttcatcgagttcggcaatccattgtgctttcaaatcatcatttttcaacaccagcgcaatggtgttcgcaccgtgtgaagccgggttggaatacaaggtacggatgatggttttgacttggctgtgggcgcgggctgctgtttcttcatcttcggccaccaaagtgaacgcgccgacgcgctcgttgtacataccgaagtttttggaataagagctggcaatcagcaattctgtattgtgtttcaagaacacgcgcaagccgtaggcatcttcttccaaaccattgccgaagccttggtaggcaaagtcaaacagcggcaaccagcctttttcggcagaaagttttgccaaagtttcccattgttcgggcgtagggtcgatgccggtaggattgtggcagcagccgtgcagcaggacgatgtcgcctttttgcgcttggctcaagtcctcaatcatgccgtcccaatccaaaccgtgtttggcggcatcatagtaacgataaggtttgtcttggataccgaccgctttggcgatggcgttgtggttgggccaagtcggattggaaatccagatggtttgcgcgttcaactggcgtttggcaaactcggccgcaatacgcaatgcgcccgtaccgccgaggctttgcgctgttttggcgcgacggctggcgatgatttcgtggtctttgccgaacagcaggatttgggtttgcgcgttgtagtcggcaacgccgtcgatggtgaggtagtttttggtggtttcgctttccaacaggcgtttttcggcttctttgacggctttgacgaggggtgtcgcgccggatgcgtctttataaacgccgatgccgaggttgactttttcggggcgggtttcggctttgaacgcttcgcccaaaccgagaatcggatcggcgggggcggcttcgatgtgcttgaagaacatagcttgctccttgatggggacggaaggtcattcgggtttgccgattttacgctgttttacacgggctggaaacagacgcaatcacgcctgcccgatatgggcgaaggtttcccagtttgactgtatgtgttctgcaagcaggggcaggtcttgttcggcggcttcgtagtatgcgccgtcccattcttcaaattcggggaactgtttgcgcagggaagggatgtctgcgcctccgtcggcgagcgtttcgatggttttgccgtgttgttcgtagagggctttggctttgtccaagactttcggcacggctttgattttccagcggcgcaggctgtcggcaagcgggttgcggaaaatatattcgccgtaaccggatgcgatgagttgcacgaagccgccttcttcgacttggctgtcgaggtagcagaatgcggtcagcgtgtgctggtcgtcggacaggcaggagagggattcgtcgccggtttgggcggtgtgttcgaggtaggcggaaacgagggtatagagcagggcggatggctcttgttggcggatgtcttccggaagggtaagcgcagtcatggtatgccgtctgaaaagtggggattatagcggattgcggctttgcgccgaaaatatcctttagcctgccgatggcgtaaaataggcgcacgccaaccacgcaaaggaaaatcaaatggacaatctgaatccgcaggaaatttccgtgttgccggaaaatctgccgctgtattgctcgggacccggcaacgagcagtggaacgggcatccgagagtgtttttgcctttgtgcgaaggagaatcgggcagcgttgcctgcccgtattgcggcacgcgctaccgccttgacggcaagatgccgcatcatcattacgcctgaacgcaaacggcggaaaaatgccgtctgaagcctttttcggtttcagacggcatttgtttggcggggcgggcttgttccggcaccgggattctgcccgacgcgccgcccagacggtgaacggcggtttccgttccccgcgtgctgccgctatggatggtggcgtttcgcctagaggaagaaaatcattgccgcgacgacggcaatcacgccgtaaatcgccatcgggataacggttttcttgataatcgcaccttcggaatttttcacatccaatacggtacatacggcgatgatgttgttgaggcacaccatattgcccatcgcgccgccgacggactgcaacgccagaatcagggtaacggacaggccggtatccaaggcgatttgctgctgaatcgggccgaaggtcaggttggacacggtgttggaaccggagaagaacgcaccgatcgcgcccagatacggcgagaaataaacccagtgttcgcccgccattgcggcaaattccttaccgatgattttcaccatcgaattgtcgccgccgaccagcatcagctgaaccataatcagcgcgcccatcagggcaagcagcggttttttggtttgattgaaggttacggaataaatcgtccaggcatctttgaatttggttttatacagcaggatgcaaatccaaacggtcagcacaaacggaatccaagccgggacgtacagcgtttggtaagacgcgctgacatcttgtccgaaaatattgccgaaggtaatcgtcagggagtcgctgacggtgattttggacaaatcaaacggcagttggaagctgaaccattcttctttgctggtcaaaatgcctttgatgccgagctgtttgatgcgcgtaaccaccagcatgccgatcagcatacccaaaggggcgagtgctttggcgacttgggcgaacggcactttttcggcattcgggtctttggcgtggtctttgctcaagccccagccttggttggcggcgaatacggacaccatcaggccgatcgcgccggcgacgagcgacgggaattcttcgttgaccatcgccaatgcgacataaggaatggtgcaggagaagacggcaatggcgacgaagcccaagtttttgcggatttcagaccaaggtacgatgaagcccaagccgatgacggggatgacgaaacctgcgaagaagtgcattacgccggtctgcctgccgatggcgaggatgtcttcggcactcaggttcagcggtgcgaaaccgaaccaggtcggcgtaccgaccgcgccgaaagagacggggacggagttcatcaccaaagtgaaaatcgccactttcaacgggttgaagcccaagctcatcagaatcggcgcggcaatcgcggcaggcgtaccgaagccggatgcgccttcaatcataaaggcaaaagcccagccgataatcatcagttgcgctacggggttcgggctgatggtcgccagccatttgcggatgacatcgatgcagcccgtggtttccatcatacggttgaacataatcgcgccgaaaatcacggtaatcggcgtgagcgttttgacgaggccggaagcggcggtggcgttgagcagcatgcccgcatcgtcgaagtagaaaagtttgatggcgtaaatcagcactgcggtaatcggcagcgcgacgtaggagggcatactgttttttttcaccatcagccaaatcagcaggacgatggggaatatgctgaggaaaagtgccataacgaatcctttttaggcatttgcatcataaggcgcgtcgaggtttggaaagacgttcaaatcccgtacacccgatattttggttaaaagataaattggtaagaccaattgttatgcgtttgcacactttacgtaatcttatgtaatcggtcaagcattttatcgataatggctattaatgcgggttaaggatagtgatgatgcggcggagggagtgtgggaaaggggcgtgtaaaaaaagccgcccgaaaggcttcagacggcattttcagtatttttccagcggcacgaataccgcgccgtccccgtccacgcggaggattgaagcatagtcgttatgccagtcgcccaaaacgatgcgggtaaagccgttttcgtgatggatatgctcgcggtgggtgtgtccgtgtatcagcctttccgcaccgaaggcgcgtacctgccgcgcggtaaaggcggcattgacatccataatatcggcgggcttgacctgtttttccattttgctgacacgcctgattttggtggcaaggcgcgtgcgccacttcaggggcagcattaggaacagtttttgcagccgcttccgatgcacgattttgcggaaacgttggtatgccctgtcatctgtacacagagtgtcgccgtggcagatgagggttttgcagccgaacaagtccaaaaccgagtaatccggcagcagcgtcatgcccgcctgccggcaaaaatcctgaccgatcaggaagtcgcggttgcccctgacgaagaacacggcaacgcctttgtcggacaatttcctgatttcacgcgcaaccgaagtattcaactcggaaacttcgtcatcgcccacccaaaaatcaaacaaatcgcccaaaatgtaaatcgcccgcgcctgcccggcggcggaagaacgtaaaaaacgcagcagcagcgcggtcagttcgggctgcttttcgctcaaatgcaggtcggaaatgaaataggcgggtttcataggcaggtttccaatcgggcggatgtcggggcggattataacgcgcccggcggcggggcaatacggcaaatgccgcgccaagcatcgggcattggcggaaccggggttcgggcgcgttaaaaatgccgtctgaaggcttcagacggcatcgagggtgcgggatgcggtaaggttttgccggcaagatatggggtggtgcggcgggatttccgttaaaatacgcttcttttttattttttccgaccattatgcgcctgacccatatcaaactctccggcttcaaatcttttaccgacccgaccacgattcatgtgccggggcagcttgtcgcggttatcgggcccaacggctgcggcaagtcgaatgtgattgacgcggtgcgctgggtgttgggcgaggcttcggcgaagcagcttcgtggcgagagtatgcaggacgtgatttttaacggtgcggcgacgcgccgtcctgcgccgagggcttcggtggagctggtgtttgacaacagcgaccacagtttgcagggggcgtgggggcagtatgccgaggtgagcatcaagcggcagctgacgcggcagggcgaatcgacttatttcatcaacaatcagaccgtgcgccgccgcgacattaccgatttgtttctgggtacgggcgtgggcgcgcgcggttatgccgttatcgagcaggggatgatttcgcgcatcatcgaagcgcggccggaggagttgcgcgcctatatcgaggaggcggcgggcgtgtccaaatataaggaacgccgcaaggagacggaaggtcgtctgaaagacacgcgcgagcatttgcagcgtttgggcgatttgcagaacgagttggcgcgtcaggtggaaaagctggaaaaacaagcggaaaccgccgaacgctacaaatccctgaccgcgcagctgaatcagcaacaggatttgctcgattacgcccaatggcggcaatcgcttgccgccgccgataaggcgaccgcgcagcatcaatctttgcaggcgcagcaggacgaaaccgccgcgcaggttcaggcgttaaacgacgaagtacacgccttgcagactgccgaacagtcgcagcagcaggcagtgcatgaattgagcaacaagcgcggcgtgttgcgcgagcagattgcccgtttggaagaacaaatccgccatcagcaaaacctgcaccaacgcatcgaacgcgacaagcaggcagcgcaggcgcagttacaacgcattcatcaagagcagcagcaaatccgcgtgcagcttgaagaaaacgagttgcaggtcgaagaaaaacaaaccgagctggcggaatgggcgatgcaggttgccgaacacgaggagcgtctgcccgaattggaagaagcccaagccacgctcaacgccgccttccaaacccagcaggacgaggcaaaccgcatccgccgcgaactggcgttgaagcagcagcagcttgcccatgccgaacaaacgattgccaagcacgaagagcgcaaaggtcgtctgaaacaggaaaaccaagccttaaacctgcccgacgaagccgaaaccgccgccgcgcaggaagcagccgccttgttgcaaagtcagcaagagcattacgaagaacaaatcattgccgccgaagaagccttacacgccgcccgcgaggcgtttcagacggcctcaaaccgcttccaaagcctgaagcagcaacacatcaccttgcaggcgcagcagcaggcgttgtcgcaaatcctgtcgcaacagcaggaagccgccgatttctggcaggcaaccgaccacgccgccgcgccgcaactgtggcaacacatcaccgcgcccgccgagtggcagcacgccttgtccgtcattcttgccgaacgcctgcacgcccgcgccgtgccgcaaggtttcgtgccgcccgagcctttgccgcaggggcaggcggcatggctttcagacgacctctcaggcggcatcaaaaaatccctgcccgtacaggcattgctgaaccaaatccaagcgcagccgccgtttcagacggcattgcactactggctcgacggcgtattgtgcgcgcccgatttgagctatgccctcgcgcatcaaaacgatttgggcgcacaccaaatctggctcacgcccgaaggtcatcaggtcgataaagtcagcgtcctgctctatgccaaacccgcgcaggaaagcctgattgcccaaaaagcgcgcctcgacggcatcgcgtccgaactggaaaacctcgcccccgaactttccgccgccgaagccgcgttcaaacaggcggaagctgccgtgcgctcgtctgaagtgcaacataaaaacctgatgcagcagcaacagcagcacacgcgccaatacagtcaagcacagcaacgcgccgccgaactcttagcgcgtaccaaccaagggcaaatccgccgcgaacacatcgagcgcgaactggcgcagttggcggaagaacagaccgtgttgcaacacacgtccgacgggctttcagacgacatcgttaccttgcaggaagccgccgccgaactcgaacaccagcagcaaaccaccgcgcacagccgccaagagcagcaaggccgtctgaaacaggcgcagcttgccctgttggaagccaaccgccaatacgggcttgccgaagtcgccgtccacaaactcaaccagcaaaaacaaaactaccggcagcaaatcgcccagcttgaacagcaaaccctcgactggcaggaacgccagcaagagcttgccctcgcctatgaaaccgagttccaaaacgacgagcagcacatcaagcttgaagaattaagcgaagccgtacagaccttggacgaagaatatattgttgtgcaagagaaactcgcgcagattcaggaacagggcagggagcaatacgctaaagtgcaaaccctgcaaaccaagctgccgcagcttcaggccgccacccaaaccgccttgttgcagcagcaggaagccctgatcaacgccaaacgctaccatcaaaacctgaccgaacgcgccgccgatttggacgcgctcgaagcgttggcgaaagaatcgccgaaagtattgaacagcagcatcggcagcctttcgcaacaaatcgaagcactcggcgcggtcaacctcgccgccctgcaagaactcgaagaagcgcgcgaacgcgacggctactaccgcagccaaagcgaagacgtgcaggcagccatcacccttttggaagaagccatcgcccaaatcgacgacaaaaccaaagcgcgtttcaaagaaaccttcgatgccgtcaacagcaaagtccaaaccttcttcccgaccctgttcggcggcggcgaagccactctcaaaatgataggcgacgacctactgaccgccggtgtgtccattatggcgcgtccgcccggcaagaaaaacagcaccatccacctcctctccggcggcgaaaaagccctcaccgccatgagcctcgtgttcgctctgttcagcctcaaccccgctccgttctgccttttggacgaagtcgatgccccgctggacgacgccaacacctcgcgtttctgcaggctggtcaaagaaatgtcggcgcaaacccagttcctctacatctcccacaaccgcctgacgatggaaatggcggagcagctggtcggcgtaaccatgcaggaaaaaggtgtctcgcgcgtcgtcgccgtggacatcaaacaggcgttggaaatggcggaagccgtttgaacgggttgcagaacggctgaatcttgccgtttttaatgaagtgttgcgatatgggttttcagacggtatttcaaacagaacagattaaaatcaaatccaaatccataaaaaatgccgtctgaacagcgttcagacggcatttcgatgtgtactgccacgtcaaatcagtggtgatggccgcagccgcattcttttttcatatcgatcaccatacggccggtgattttgccttcgcgcatttcttggaaaatggcgggtgcttcatccaaagcacgcagttggactttcggcacaaccaaaccttccgcgccgaattggaaggcttcttccaaatctttgcgcgtgccgaccaaagagccgaccacttcgatgccgtccaaaaccaaacgcgggatggacaaatccatcgattccggcggcagcccgatggcaaccacacgtccgcccgcgcggacgcaattcacggcagagttgaatgcggcagcagatacggcggttacgaccgcagcgtgtgcgccgccggttttttcctgaatcactttggcagcgtcttctttggcggcgttgacaaccaaatccgcgccggtttctttggcaaacgccagtttgtcgtcgttgatgtcgatggcgacaacgtgcgcgccgaatacttttttcgcgtattggacccccaagttgcccaaaccgcccgcgccgtagatggcaatccactgtcccggacgaacgccggaaactttaatggctttataagtggttacaccggcacaagtaatgctggaagcttgcgcaggatccaaaccttcagggactttgaccgcgtaatcggcactcacgatacagtgggtcgccataccgccgtcggcggtgtagcccgcgttcaatacggaacggcacagggtttcgcggccggtattgcagtattcgcaagagccgcagctttggaacagccaagcgatgctgacgcggtcgccgactttcagatttttcacaccgtcggcaacttctttaaccaaaccgatgccttcgtgtcccaacacgcggcccggtttttcgccgtagtcgcctgccgcaacgtgcaggtcggtgtggcacacgccgcaatattcgacttcgaccaatgcctcgccgtattccaacgggcgaacctcgcgttcgattacttccacatcgcccgctacatttttattcacaacaactgcctgcattttcatgattgcgctccttagttacggcaaaaaaacctgtaaacggaatgttgtccgatataagggtaagcatacgcttccgcatctcacaggtcaagtggtatgttgttgaaaaatatagattatatgttatattataacatcttggaaaggcacggcatcggggcggttgccggatgaggggcggcaggtttcaagtttgaaaaaccggacggcaaacccgtaaagataccgtctgaagctgtgtccggacggcatctttacgggtttgcgggcttcggcggaggattagtcgaagccggggcaggattggtttgtaccggaagcggcaatggtaccgccgtcgttgagcgtaacgacgcaggtttcgccgtcgttggtggtgggattggggtcggcctgaagggtaaagtggtcggggctgacttcgcttaaagtgatatcgaaatattcgttttgtttcagtttgtttttgtcgtaggttttaaacgtccctttttggcggtagtaacgttccatggtctgcgcgttgtgcagcagggtcgtcctgacttccgacaggcggacgcgccggatgtaggttttataggaagggtaggtgatgagcgtcaggatgccgaggatggcgacggcaatcatcagctcgagcagcgtaaagcctttttgaacgtttttcatagcaatgtgtttccatttgtttgtcggtcgacggcattataacgccgtatcggaaatggcggaatatgtaaacggattgaaattttcgggaaagcagattgtataagccatttaaaacaaatggttatttttattgtcggcagtttgccgccttggatggggcagggacttgcggtagaatccgcttccgatttatgggattgacgcatacagagaattgaaaacatggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataaacgaatatgccgtctgaacacggaaacggtttcagacggcatttgttattgatttacggaatattatgagcttgatcgaatgtaaaaacatcaaccgctatttcggcagcggcgagaaccgcgtccatattttgaaagacatcagcctgtcgatagagaagggcgattttgtcgccatcatcgggcagtccggttcgggcaagtccacgctgatgaacatactcggctgtttggataccgccggttccggttcgtaccgaatcgacggcatcgaaactgccaaaatgcagcctgacgagctggcggcattgcgccgcgaacgcttcggtttcatcttccaacgctacaacctcttaagctcgctgaccgcaagggacaacgtcgcgctgccagccgtctatatgggcgcgggcggcaaagagcgttccgcgcgggcggacaaactcttgcaggatttgggtttggcaagcaaagagggcaacaagcccggcgaactctcgggcggacagcagcagcgcgtctccatcgcccgcgccctgatgaacggcggagaaatcatcttcgccgacgagccgaccggcgcgctcgataccgccagcggcaaaaacgtgatggaaatcatccgcaggctgcacgaagccgggcataccgtcattatggtcacgcacgaccccgacatcgccgccaatgccaaccgcgtcatcgaaatccgggacggcgaaatcatttccgacacctcgaaaaatcccgaaatccccgcaagcaatgtcgggaggattcgggaaaaagcttcgtggtcgttttattacgaccagtttgtcgaagccttcagaatgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattgaggttggacaaagatgccgtctgaagctgcaggaccggtcattttggagcagaaacttattggataaaaacggtttcttagattctacgttccagattcccacttgcgtgggaatgacggcggcgggggttcgatgattgcacacaacgctcgagtcccgtcattcccgtaaagacgggaattcggttcgttcggctttgcttgtttcggataaatcacggtaactcaatattccagattcccgcccgcgtgggaacggcggcggggcttcgtattgttcaatttattattttcaatcattcaatgggttaggatgtgtttgttggcttgctaactttcagggcggattggttttcaggcggcatttcccgcaaaaaaggcttggaattttccaagccttttttgcggatggattattgatttttgcggatgatttcctccagttggggcatcgggctgtagccgctttggctgcgcccgttggggaagacgagggtcggcgtgccgttgaagccgaattgttcgcccaaggaagtggtttccgcgacgggattgtcgcagatgctgccgccgaccgggaatttgcctttacgcatccaatccgtccacgctttggcgcggtcgggctgacaccataagatttgcgccttgcgcgcggcatcggggtgcaggccggcaatgggcatcataaagctgtaaaccgtcacgtcggtcattttttcaaactcgtgttccaagcgtttgcagaacggacaatcggggtcggagaagacggcgactttcagcttgccgttgccgcgcacttctttgatggctttgtccaaaggcagggaggcgaagtcgattttgttcaaatcggcggcgcgttcttcggtcaggtttttgcgcgtgtcgatgttgatgagttcgccgacgaacatatagccgccttcggcatcggtgtagataatctgcctgccgctgacgacgacttcgtaaatgcctttgaccggtgtttcgctgacgctcaacactttcaaatcttgggcggaataggttttttccaaacgcgctttcaaagaggcggcaacggatttgccggcggactcggctttgacggcgggttcggcgttggcattggaaacgggcgtttgcccgcaagccagcagcgggaggacggtaaagggggtcaagattttgattaacttggttttcatataaagatgattgcgcgtgttggaaaagcggaattgtatcaaatctctgttgcgcctgcattgcgcctaggctcaatttatcgtctgaaaatagcttccggctgttaaaatacgcaaaaaatgatttgcttgtttgtatgatttaccaccgcatcgccgtaaacgtgccgctttcagacggccttttgacttattcccattccgatccgcttcctccgggaacgcgggtgcttgtgcctttccgcaataaaaccgtggtcgggatggtgtgggaaacggatattgcgcccgatatggatatggcgcggattttgagtgttcagacggcctttgtggaagaaaagccgttgcctgaaagctggcgtgatttgttggcatttacgtcgcgttattaccactatccgactgggcaggcggtgtttgccgcgctgccgcagggtttgaaggaaacgcgcgcggtggaaatgccgcagccgccgttgttttatgctttgaacgaagcgggcagggcgcaaacgccgccaccagctcggttcaacaaaaaagcggctttgtgggacgcactgctttcgggcggaatgacgatggcagcgttgaagcaggtaaacgcgcaggcggcgaaattgattgaagattgggcggagcagggttggattgaaacaacggaagcggcgaaacctgtattgaggtcgtaccacgggcaggcttcgcactctgaatttgtgttgaatgccgaccagcaacaggcttccgatgaaattcagacggccttcggcagcttccagccgtttttgctgtacggcatcaccggcagcggcaagaccgaggtgtatttcgatgcgatggcgaaagtgttggcgcaggggcggcaggtgttgtttctgttgcccgaaatcaacctcacgccgcagcttttgaagcgggtggaaaaccgttttgccgacgtgccgaccgccgtgttgcacagtcagatggcggcaggcaagcgcacgcaggattatttgcgcgcgatgttggggcaggcgaaattggtcatcggcacgcggctggcggtgttcacgccgatggatgatgtcgggctgattgtggtcgatgaggaacacgacggctcgttcaaacaggacaacgaattgcgctaccacgcccgcgatttggcggtgtggcgggcgaagcagggcggctgcccgatcatattgggcagtgccacccccagcttggagagctggcacaaggcgcaaagcggcgcgtaccgcctgctgcaactgaccgaacgcgcccataccgccgcgcaactgccgcaagtggacatcctcaacgtaggccgtctgaaacttgacaacggcttctcgccgcaagccttgcagcttttgaaacagaactttgaagcaggtggcatgtcgttggtgtacctcaaccgtcgcggcttcgcgcccgcgctgttttgcggcgactgcggttataccttcggctgcccgaactgctccgccaaaatggtgctgcaccaacgcgcccgccaactgcgctgccaccactgcgaccaccgcgaacccatcccgtacaaatgccccgactgcggcaaccaagacctgaccgccgtcggccacggcacgcagcgcgtcgaagaaaccctgcgcaccttcctgcccaaggcagccgtcgtccgtgttgacagggacagcaccgcgcacaaaaacgactgggcggatttgtaccgccgcatcgccgacaacaaaatcgacattttggtcggcacgcagatgctcgccaaagggcatgatttcgcgcggctcaacctcgttatcgtgttgaacgctgacggcagcctgtacagcgcggactttcgcgccccggaaaggctgttcgccgagctgatgcaggtgtccggcagggcggggcgcgccgacaaacccggcaaggtgttgatacagacccaactgcccgaacatcccgtcttcgccgccgtcaaagcgcaggactacgccgtgtttgccgaaaacgaattgaacgagcggcaaatgttcgccatgccgcccttcggtttccagaccgccgtccgcgccgacgcgccgcgcgttgccgatgcgatggagtttctcaatgccgccaaagaaaccctcgccccgcttttgcccgaaagcgtttcacagttcggcgccgccccgatgctgatggtgcgcctcgccgaacgcgaacgcgcgcaaatcttcctcgaatctccgtcccgacaggatttgcaccgtgccgtgagtttgtgggcgcaggtgttgcagcaaaaccgcgacggcaaaatcagatggtcggtggatgtcgatccgcaggaggcttgattattggcaatccgatgccgtctgaaaaccgtttcagacggcatttttattccggatcgtctgtaaacgcattcgcccgaaatatcggtataaacgtgaaaagatacagtacgaatacggcggcggtcagaatcgcaggaacggtaatgaaaaatatcgggttcacgttcatcaagaaagcgcgcgagacggcggcggcgaaaaggatggggacggcaatgcggcagagtttggggtagtcgagtttggtaaagccgctgtgccacagtccggcggtcagccacaccatcatcacgccgcccatcatgccgccgagggtaatcaggtgcaggggcgcggaggcgggcaggttttgtaatttcgccgcgcctgtccacaaatagcctgcggcggcaaagagttggagcaggtaataagtgcggacgtagtgtttacgtaagagttcgtgatggtgaagctcacgcagcttggcgagcaggatgaagccgacggcgagcgcggtaaaaccggcggtttgcgcgggcagccaaagttcggcggcggcgtgcaagagcaggaaagtaatggcgatgtttttataaacgatatttggaataaaaacagggtctttcagacggcattctttcagggcttccgcgcccaaaagaatactgacgcgcacggatacgaacatcaccgccgccatatttagatgcacttgcgcgcgcaacaggttcaaatcgccgctgacggcatatgccgtctgaaaaacagtgaacgcggcaagtaacattagcagggcgaagttgtcggtgtttcggtctagccaaatcagccgggcgcagaacagcagcaacaccagccaataggcggcgacgaaaaacgaggcagtttgcggcgaaaagggcagtatagcggatgcggcgagcaataatgccgccatcaaagtcgcgacaggtttcaggttacccgaaaaacccgtccagtccaacaaagccgcagtcaaaaaaccgccgtatgccgccggcagcataagttccaagaaaatttggcggtgcaggacgatggcaccggggttgatgaaaaacaccagcgcaccgagtatggcaagcaccgccgcgccgacgaaaaacggccgcatagcaactgtatttttcaccccgtcgggcaaaaataccaaaactcaaatcaagccgtccggataccgttttcggcggtatcgttttcggcaaaataatcacgcatccgggcattcgatatcgtcagcagtttgcgcatacatgccgtaacggcaaccttatacggcttacccttggacagcaggcgttggtagaaatcccgaataagcggttcaaaacgtgtcgctgccacggtagccatatacagtgccttacgcaccgcagaccttccgccaaagcagcggcttttgaatttggtttcctcgctctccctcgggtgcggggcaatgccggccaaactcgctatccgtttgtgcgacagccgccccaattcgggcagcatcgccatcagcgtagccgtcgttatcgaaccgatgcctttgatttgctccgccacttgggctttgccgtcaaaatgcgtgtgggtgtggtcgtcgatttgtttgtccaattcgtcaatcagccggtcaaaatgggcaatcagttgtttgacgcttccgacttgcgtttcatgaacctaatgcagacggtttttctcggcagtccgcatatccaccagttggttgcggcggttaaccaaggcttccaacacttcttccacttcggtgggcgggtggtagggcatggtttgcgaaccttctttctgcgtcatcatctgtgcgaagaaggcgagcattttggcatctttggcgtcggttttggtcagcggctgcgattgggcaaactgatgcgtctgacgcgggttggcgataatcacggctatgcctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgactcacttggtgcttcagcaccttagagaatcgttctctttgagctaaggcgaggcaacgacgtactggtttttgttaatccactataacagcaaccctgtcgccgtcattcccgcaaaagcgggaatccagtccgttcagtttcggtcatttccgataaattcctgttgcttttcatttctagattcccactttcgtgggaatgacggcggaaggtttttgtttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcttgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaaatgaaaagcaacaagcatttatcggaaataactgaaaccgaacagactagattcccgcctgcgcgggaatgacgaatccatccgcacggaaacctgcaccacgtcattcctacgaacctatatcccgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttaaatttaatccactatataaaaaatttccagagaaccgatacaacagttggaacttgggtttgggaatattacggtagatgaacttggaacctctgttatgctatggtcttttatctcaattgaaaaaagcgcgaatcaaacggttcgcgcttttttcagacggtattaattattttttgtcgtcttttacttcttcaaagtcggcatctacgacatcatcgtctttctttgcagaagcattggcttgttcgctttcgcctgcttgggcttcagcttgtgcttgagcgtaaaccatttcccccagtttttggctggctgcgcccagcgcctcggttttggcatcgatagcggctttgtcgtcgcctttaactgcttcttcggcttctttcagcgcggcttcgattttttctttctcggctgcgtcgagtttgtcgccgtagtcggccaaagattttttcacagagtgaatcagggcttcggcttggttgcgggaagcgaccaattcagtcagttttttatcttcctcggcattggcttcggcatctttcaccatgcgttcgatttcttcttcgctcaaacctgaagaaccttggatggtgatgttggctgctttaccggtgcctttgtctttggcggaaacgtgcaggatgccgttggcgtcgatgtcgaaggttacttcgatttgcggcataccgcgcggtgcaggtgcgatgtcgcccaagttgaactgacccaaagatttgttggcagaagcgcgttcgcgttcgccttgcagtacgtggatggttactgcgctttggttgtcttcggcggtagagaacacttgcgacgctttggtcgggatggtggtgttcttctgaatcagtttggtcatcacgccgcccatggtttcgatacccaaagacagaggagttacgtccagtagcaatacgtcgctgcggccgccgctcaatacttcgccttggatcgctgcgcctacggcaacggcttcgtcagggttcacgtctttgcgcggttctttgccgaagaaggctttaacggcttcttgtactttcggcatacgggactgcccgccgaccaagattacgtcgtcgatgtcgccggtgctcaagccggcatctttcaatgcaattttgcaaggttcgatagagcgggtaatcaggtcttcaaccaggctttcgaatttggcgcgggtaattttcatcgccaagtgtttcgggccggttgcgtccatggtgatgtacggcaggttaatttcggtttgctggccgctggacaattcgattttggctttttcggcagcttctttcaggcgttgtagagccatcacgtcttgtttcaaatcaatgccttgttcttttttgaactcggcgatgatgtggtcgatgaggcgttggtcgaagtcttcaccgcccaagaaggtatcgccgttggttgccaatacttcgaattgtttgtcgccgtcgaggttggcgatttcgatgatggaaatatcgaaagtaccgccgcccaagtcatatacggctactttgcggtctttgttgtcgcctttgtccataccgaatgccaaagcggctgcggtcggctcgttgatgatgcgtttcacgtccaaaccggcgatacggcctgcgtctttggtggcttgacgttggctgtcgttgaagtaggcagggacggtaatcacggcttcggttactttttcgcccaagtaagcttcggcggcttctttcattttacgcaggacttctgcggaaatttgaggaggagacagctctttgccttgtgcttttacccatgcgtcgccgttgttggctttgatgatttcgaaaggcatagattcgatgtcgcgttggacttctttgtcttcaaatttgtggccgatcaaacgtttggcggcgtaaatagtgtttttggcgttggttaccgcttggcgtttggcaggcgcaccgacgaggatttcgccgccgtccaaataagcgataacggacggcgtggtgcgtgcgccttctgcgttttcgatcactttggtttgaccgttttcggaaatggccaaacaagagttggttgtacctaagtcgataccgattacttttgccatgtggataatcctatttgattttgcttattttgagaaatatgttggaacattttgtcccgatgggctgtaaatagggcgggcggcgggctgtttcaagctacagcatggctataagtatataactttatgaatatattggttttatatttgatttaatacatttggctccaatgcattcaagcataatgtttcaaatggcaggcaggtttattcatagacgatgccggcgagcatttcctgttcgttcaagttgccgtactctttttcccagtcgtgtgaagactcgatgatgtcgcattctttggaaagggagacttgttctgcatccatatctttggcgttcagtatgttgaattgttcgcacagggatgcggataaagtgatgtcgggctgtttggcttcagaacggttttcttggaaggcaaagcagaatgcggtaaatgccgcagtatagataagatatttgccggttttcttcatttttctatcctttttctgtcaattcaggattaaacctatggaaaaatctgaaaaattatgtattaagtaagaaaaatcataatttaaatttagtttatcataattgttccgttttttggatagctaaggtaaaatatatttcatgtttactttagatgattgaatgaaggggagtggaaggatatttatggaaacctttaaagacagactggtttttttatggaaaagcgaagcgaggcaggcaaaaatcgcatccgatattgaaatgacgattgcgggcttcagcaggatatggaatgaaggcggtctgccaaagtctgaaacattgaaaaaaatcaagcagttgaaggggtgtagtatcgattggctgctgaccggggagggtaatccgtttccggatgaagccccaaaaaaatcccttgcttacgatactttgggcaatgaagtcgatacggacgagtttgtcttcgtgccgagatatgatattcgggcggctgcgggatacgggcagtttgtcgatcatgaggaaccggtatttacaatggcgttcagacggcattggattgagaattatgttacccgcgatacgaaaaacctgtctgtaatttccgtcaagggggattcgatggagggggttttgaatgacggcgattcgattttggtcaatcatggtgaaaatacgccgagggacggtctgtatgtgttgcggattaatgaaaatctgctggttaaacgtttacagattgtaccgggcgggattatcaatgtgatttctgcaaacgaggcttatcctgcttttgaaatcaatttgaacgatttgaccgatgatgtggagattatcgggcgtgtcgagtggttcggcaggacgatttgagtttggggcttgaaattgcaggcggtcaaacttatctattggaacaattcctttttcaaaggcgaagcctgcttgcctttgaagggggtttgagagagaatgcagaaaatattatattaaggaataacaccatgtcggatgaaagccctattatttttactgacagctgctgtgccaaagttgccgatttgattgccgaagaaaacaatcccgatttgaaattgcgggtttttgtcaatggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtttgcagggttcgcaattcgtcatccgcaatccgaatgcggaaacaacctgcggttgcggatcgtcgttttccgtatgaccgcttggtttgtgtgatgccgtctgaacgttcagacggcatttttacttttagaaaatatattatcgggatgaattcacatataatccgattgtttgaagatgaatcgggtttcccgaaaggaacgggcggaacggtatcaggcgtatttgttcccttatgattgagatgagtaaagattaccgaaacgatttgtacgatgtatatgtttcttacccgccccaagtggatcgcgggcttatccgggagtgccttaaggagaatctcggcgaggaaaaggcggaaggattgatcgaatcgctcgattccaaacctcaagtgctggttgaggaaaaatgcacttgggcgaaacgggaagagttgcatgattatttcagctatttgggtttggatattattacccggagatatatggagttggaaacggtcgtgccgccggaggaaggggagggcgaaggagaaggcgcggatggggaaatgcccgaatatcttgaacttcacggcgggcgggaagatgatatttccgcaccttcgcaacccgaaccgccgtcccgcaatatcaaactgctggttttcgggctgctgattgcctttttgggctatctgctcggtaagattttttgattgtccgataaatgctgtattcgggattttatatatgaaatggttgaaacgcctgacggttattgtcgggactttttaccgctatcggctggcaggtctgtgtgcttcgctgatgggtagcggttggatatgcgctctgctgaaaatgatgccgcagtcgtccaaattgaaaaacgaaccgcctgctgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgttgggtcagtccatcgaaaagctgtatgcggaatttgaaaccgagcccatcgccagcgcgtccatcgcccaagtacacaaagcccgcctgcattcgggcgaacaagtggcggttaaagttttgcgccccaaccttttgcccgtgatcgaacaggatttgtcgctgatgcgctttggtgcaggctgggtcgagcgtctgtttgccgacggcaagcgtctgaagccgcgcgaagtggtggcggagttcgacaaatatctgcacgacgagttggacttgatgcgcgaagccgccaatgccagccagctcggacgcaatttccaaaacagcgatatgctgattgtgccgaaggtgttttacgactactgcaccagcgacgtgctgaccatcgaatggatggacggcacgccggtttccgacatcgccaaactcaaagcagacggcatcgatttgcacaaactcgccgattacggcgtggaaatcttcttcacgcaagtcttccgcgacggctttttccacgcggatatgcaccccggcaatattttggttgccgccgacaaccgctacatcgccctcgatttcggcatcgtcggcacgctgaccgattacgacaaacgttatctcgccatcaacttcctcgccttcttcaaccgcgattaccggcgcgtcgccaccgcccacatcgaatcgggctgggtgcccgccgacacgcgcgcggaagagttggaagcggctgtccgcgccgtgtgcgaaccagtgttcaacaaaccgatttcgcagatttccttcggcttggtgctgatgcgcctgtttgaagtcagccgccgcttcaatgtcgaaatccagccgcagctggtattgctgcaaaaaacgctgctcaacatcgaaggcttgggacggcagcttgatcccgatttggacttgtggaaaaccgccaaaccgtttttggtgaaatggatgaacgggcaggtcggccctaaagccctttggcgcaacctcaaaaacgaagcccccgactgggcgcaaatcatcccttcattgccgcgcaaaatcagtgcgttgattgatgaaaaccgccagcaggaaatgcgtgatgcctatatccatttggtcaaagtgcagcagcggcaaagcctgtggctggctgtgattgcggttgttttgctgctgattttgcttttgaaataggctttgtccgaatcatcgcccgactccgcccgtttataaggaaatcggttatagtggattaacaaaaaccagtacggcgttgtctcgccttagctcaaagagaacgattctctaaggtgctgaagcaccaagtgaatcgattccgtactatccgtactgtctgcggcttcgtcgccttgtcctgatttttgttaatccactatatttccggttgcgtgggaatcgggtgtattgaataaaaggcattttgtccgactggcaagtgccgacatcggcggcatatcaaggcgcaggcttgaagcgggcaatgtcgtctgaagcccgtttggcgtttcagacggcattggtgcggatattcaaatcataaagtcgatttcggtaaactggatattttgatccatatccgccgacggtgttttgagcgatcgcgccacgggtttggcgggtacgccgacaaccgtgatggacggcggcacgtctgaaaccacgacgctgcccgccccgattttggcattgctgccgatgcggatattgcccaatatcgaggcgtttgcgccgatcatcacgccgtcgccgattttagggtggcggtcgccgccttctttgcccgaaccgccgagcgttacgccgtgcaaaatcgaaatattgttgcccaacacggcggtttcgccggcaacaaagccggtggcgtggtcgagcatcagcccgtatccgaaacgggcggcgggatggatgtccacgccgaatacttcggacatacggttttgcaggaaatacgccagcgttttgcgcccgtcgagatacagccgatggttgatgcggtgtgcctgaatcgcgtggaagcctttgaaatataaaagcggcagcgaatattcgtcgcaggcgggatcgcgttcgtagatggcttttaagtctgcttcgacgcatttgccgatttgggtgtcgctgcccaacgcctgctggtagatttcaaacagcgcgcgcacgtccataatcgggctgccgagtttgctggaaaggtggtaggcaaggacggagccgagggactcgtggcgcaacacggtttggtgcaaaaaacttgccagcatcggttcggcggagaccgcggccgcggtttcttcgcggatggtgtgccagaggtcgaaaccggttgtgtttaaatggtcttttttcatgagtgatgacgtttgaaaatcgatatggtcggcagtatcttaccgtctatattattttttcggtaggggatttgaaaatgaatttgaaattctctgcttttgcttgaagtttcttgaaaatgtccttatcttgcgcgggtaataactggattttgatttccaatttgttttaagggatacgatatgagcgaacagacacagcagcaaaacagtgaagaagcggttgaaaatgtggaggcggtggaaaccgtcgagacagtaggaaatgcggacggtgtgcaggaacaggctgccgcagagccggcttatgaggatttgcaggcgcggattgccgagctggaagcgcagttgaaagacgagcagctgcgcgctttggcaaacgagcaaaacctgcgccgccgccaccagcaggaaattgcggatacgcacaagttcgccggacagaagtttgccgtggaaatgctgccggtcaaggattatctggaaatggcgcttttggatcagagcggcaatttcgatgcgctgaaaatgggcgtgcagatgactttgaacgagttgcagaaagcatttgatgctacgcaaatcaaggaaatcaaccctaaagcgggcgataagctcgatccgaatatccatcaggcgatgcaggcggtggcaagcgaacaggagccgaataccgtggtgggtgtgatgaagaagggttatacgctgtccgaccgcgtgttgcgcccggctatggttacggtggcgcagaaggaagcctgaaggcgtctggggaataatctgatttatttcctgaagcgcgttttgcgtataaaccgatcgaagtaaagcggcaatgccgtctgaacccgcctgtcgggcttcagacggcattttatagtggattaacaaaaatcaggacaaggcgacgaagccgcagacagtacagatagtacggaaccgattcacttggtgcttcagtaccttagagaatcgttctctttgagctaaggcgaggcaacgctgtactggtttttgttaatccactatatttcggcgttaacggtcaacccgtatgccgcctgcctgtttttcttcatccagtttcttttgcagggtgtcgcaaggtgtgtcgcagtcgcacatttttttcatacccaaggcagtaatgccgccgcaactgcctttgatgctgcgtttggagaaaatatagccgaccgccataccgatgatgacggtcaggaagatgccgaaggtaaggagcagggttttcatggtgtttcctaatcggtttgtatgtttagcggagcagtttttcaaattcggaagacatggcggtgcggtagccgcctttatccctgacaatcaggaaaacagcgagtttttcgcgctctgccagctttaaggcttcggtttcgcccaatacgaataatcctgtggacaagccgtccgccgtcatcgcactgtctgcgaccacgctgatggaggcgaggttgtggctgatgggtcgtttgttgttcgggttgatgatatgggagaggcgtttgccgtttttatcgacgtggaaaatacggtaatcgccggaagtggcaagcgaacggttgttcagcgggacgataatctgcgtattgccgccttggacgatattgggctgctcgataccgatgcgccacggttcgccgcgcgcgtttttgcctttgccgtgcaactcgccgccgatttcgaccagataattttgaatgccgtatttttccagttcgcccgcaactttatcaacgccgaagcctttggcaatcgaagataaatccaaataggccttggggtgggttttgctcaaggaagcgtaatctttgccttgtttcaaaatgattttgtctatgcccgtataagatgccgcctgtttgatttgttccggcgacggttcacgggtaacggatttgtcggggccgaatccccaaaggttgaccaaggggccgacggttacgtccagcgcgccgtgtgtcaggcggttcaggcggacggcttcggcagtaacgtgtgcgaagtcgcttgaaatgcggaggggcttgccggctgtgtgttggttgaaccggctgatttcggagtcgggctgataggtggacatctgccggttgacttctttaagcgcgtcatcgatgcgtttttgtatttcggcaggtgaggggagtttgtcccgattatttgaaaggtatttgacggtataggtcgtgcccatcgtttcgccttgcagggtaacggtttgcgcggtttgttccgaacaggcgttcaggaagatgaaacccagggcaaatatcaagacgcggataaagttcggcaggcgtgtttcagacggcatagtgtttgacggttttggcaaatggtttgaattatatcgcaaaacggccggtatgtttctatgccgatgccgtctgaagggtgttcggatggcatcggcatagaaaaaggaagaaaccgaggtttcttccttttgtatttgaagccgaatatttaaccgccgaaatcgtccaagaggatgttttcgtcttccacgcccaagtctttgagcattttgatgacggactggttcataatcggagggccgcacatataaaattcgcagtcttccggtgcttcgtggtttttcaggtggttttcgtaaaccacgttgtgaatgaagcccgtgtagccgtcccagttgtcttccggcagcgggtcggacagggcgacgtgccacgtgaagttcgggaactctgccgcgagttggtcaaagtcttcgacatagaacatctcgcgtttggaacgtgcgccgtaccagaaggtaatcttacgtttggagttcaaacgtttcaactggtcgaaaatgtgggaacgcatcggagccatacccgcaccgccgccgataaataccatttcggcatcggtgtctttggcgaaaaattcgccgaacgggccggaaatcgtaactttgtcgccgggtttgagcgaccagatgtaggacgacatttgtcccggaggcgcatcaggtacgcgcgggggcggcgtggcgatacgcacgttcagcataatgatgcctttttcttcaggatacgaagccatagagtaggcacgcaaaatcggctcgtccactttggaaacgtattgccacaaattgtatttgtcccagtcttcgtgatattccttaggaatgtcgaagtctttgtaggcaacagtgtgaggaggagcttcaatttgaatgtagccgccggcgcggaaggggacttcttcgccttcgggaatggcaagcttgagttctttaatgaacgtggctttgttatcgttggagatgacggtgcattcccattttttcacgccgaacacttcttcggggacttcgatgtccatgtcggttttgacgttgacttggcacgacagacggcagccttcgcgtgcttcgcgtttgctgatgtgggacagctcggtcggcaggatgtcgccgccgccgctttttacgacgacgcggcattgtccgcacgaaccgcccccgccgcaggcggaggggataaagatgccttcgttggcaagcgcgcccaagagtttgccgccggcgggcatcgtcagctctttttcgccgttgactttgatggtgatgtcgccttcgctgaccagtttggatttggcaaacagaatcatcagtgccaaaaccaaaacgatgacggtaaacatcacgatacctaaaataatctccataccgatccctttcttataactggatgccagagaacgacataaacgccatcgccatcaggccggcggcgataaaggtaatgcccaagcctttgaggcctttgggagcgtccgaatatttcattttttcggtaatgcccgccaaagcgacaatcgccaacatccagcccaagcccgcgccgaagccgtatacaacggactcgccgaagttgtattcgcgttgcgccataaacgatacggcgccgaaaatcgcgcagttcacggtaatcagcggcaggtagatgcccaatgcgttatagagggcggggacgaatttatccaagaacatttccaaaatctgcaccaaagcggcaatcacgccgatgaaggtgatgaatttcaaaaaggtcaaatccacgccttcggcaatcgcgccgtctttgagcagcgagtaaacgagttggttgacagggacggacagcccgagtacgaaaattaccgccacacccaaaccgaatgcggtggatacttttttggataccgccaaaaacgtgcacatacccaaaaagaaggatagtgccatattttcaatgaagacggatttgatgaagaggctcaaatagtgttccatagcttattcctccgcctgttcgggtttccaggtacgcagtccccaaatcaaaaagccgatgatgaagaacgcgctgggggcgagcaggaacaagccgttggtctgataccagccgccgtcctgcacggtttggaaaacggtgtagcccaagagtttgcccgagccaatcagttcgcggacggtggcgacgacaagcagcattatcccgtagcccgcgccgttgccgatgccgtcgatcaggctttccagcggcggctctttcatcgcaaatgcttcggcgcggcccatcacgatacagttggtaataatcagaccgacgaatacggaaagctgtttggacaattcgtaggcaaatgcctgcaagagttggtcgaccagcgtaaccagcgacgcgataatcgccatttgcacgataatacggatgctgttggggatgtagttgcgtaccagcgaaatgaagaagctggaaaaaccggttaccaaagctacggaaatacccatcacgatggccgtctgaagtttggtggtaaccgccaaagccgaacaaatacccaaaacctgcaaggcaatcgggttgttgtcgataaagggtgaaaacatcaaatgtttcaagcgtttcatatcagccattattgcgctcctgctgatttcaatttgttcaggtaggggatatagccgttttcgccgaaccagtaggcgaacgaaccttgcacgcctttggatgtcagcgatgcgccggagagggcatctacgccgtgttctttgtccgaacccgcgcctttgccgacgtgcagggcgagtttgccttgtccgtcaaacagttttttgccgacgaatttttgctgccacaacggattgccgatttcgccgcccaagcccggggtttcgccttgttcgtagtaggtaatgccgttgatggtgttgccgtcgggctggatggcgacaaagccgtacatgaccgaccacaaaccgttaccgtgcataggcaggatgatttgcccgattttgccgtcttcgccttttaccaaataaacctcggtgtatttggcacggcttttgatgcctgccaaatcgtcttcggttttgatgcggatgctttgggcagggtctttgcctgcgatgcgcgcgctgaagtctttaggcgcatcggcgacgtattcgccggtcgccaaatcgacaacacgttgctcgatacgctcggcaaaggttttaccgatgtcggtgtccttatccatcaaaccggctacgctcaagatatagccttgtttgtcttggagtttttgtttctcttggatgggtttcaagccgacgaccgcaccggcaacgatgaccgagcaaatcaggctgaccgccaacacgacaatcagcgtgccgctgaagctgtctttatcgaatttcttagccattgctgcgcgcctttctgcgtttgatgttcgcttgtgcgacgaaatagtcgaaaatcggggcaaacaggttggcaaacagaatcgccaacatcatgccttcggggtaagccggattgaccacgcggattaatacgcacatcacaccgatcagtgcgccgtaccaccatttgccgacattggtaaaggaagcggaaacagggtcggtcgccataaacagcataccgatggcgaagccgccgaccaccaagtgccagtaccaaggcatagcaaacatagcgttggtgtccgaaccgatgaagttgaacagcgaagacatcgcaatcataccgatcatcacgccggcaataatgcgccaagaagcgatgcgggcaaacacgataaacgcgccgccgattaagagtgccaaagtggagacttcgccaatggagccgggcagtttgccgataaacgcgtccatccaagtgatggtttgaccggttacggcgtttttcaggccgtctgcaccgtgtgccgcccattgcgccagtgcggttgcgccggaatagccgtcaaccgccgtccaaaccgcatcgccgctcaagttggcagggtaggcgaagaacaggaaagcacggcctgccagcgcagggttcatgaagtttttacctgtaccgccgaatacttctttcgcaaccacaacgccgaaagaaatacccaaagccgcctgccacagcggcagcgtgggcggaacgattaaggcaaacagaatcgaagtaacgaagaaaccttcgttgatttcgtgtttgcgcacggtggcgaacaaaacttcccagaaaccgcccacaacaaatacagtcgcgtaaatcggcaggaagtaaatcgcgccaaacagcattttgtccgacacgcccgcttcagacgacatattgatgcccaaagcgttggcaaaggcgtaatgccagtcgttggcgatgttttgttgcagcaaatcaggcgttaacgcaccgaatgcctgcgcgccgacgttgtacataccgtagaacatggcagggaacaaagccagccacaccaaaatcatcatgcgcttggagtcgagcgcgtcgcggacgtgcgccgctttgcgcgttaccgcgccggatgtgtagaaaattgtcgccgcagcttcgtagagggcataccatttttcatgtttgccgcccggcaggaagtgcggttcgattttttccagaaaatgtttcaagcccataatcagccttccttctcaatggtttccagcactttgcgcaacagcgggccgtattcgtatttgcccgggcagacgaagctgcacaaagcgaggtcttcttcgtccaattccaagcaacccaatgcctgcgcgctgtcggtatcgccgacgattaaatcgcgcaaaagcagggtgggcaggatatccaagggcatcacgcgctcgtaagtaccaatcggcaccatggcgcggtcgccgccgttgacggctgtgttgaacttgaagagtttgtttttcaggaaatggccgagggttgtacgcgtgatggagtatttgtccggctgcggcgcaacccagccgaacagctctttgctgcggccttcttcgataacggaaatctgattgtggtagcgtcccaaataatcgtgcgcgccttgtgtaatcgcgccgttcaataccgaaccggaaatcacgcggttgtctgtgtcaaccaattcgcccgcagtaatttgcgatactttcgcacccaaaacggtacgcaagaggcgcggtttgttgacttgagaaccacctagggcaatcacgcgctcggtgttcagacggcctgttgcaaacaaacggccaatggtaattacatcttgataattgatggtccacacggttttattcgcgccgaccggctcgatgaaatgaatgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtagcgttcaaactcgatttcgtcgttgccttcaacggcaatcacgactgactgaagtacgcgcttttcgccacggtgaatcgcggcgattttgcctgaagccggcgcagtaaacaccacgcccggattctttttgtcttcaaacagcacttggccttttttgacggcatcgccttccttgactttcatcgaggggcgcataccggcatattcttcgccaagcaacgcgacttcggtaatggccgggccgtcgtaaacggcttgctccggtctgcccgcgatgggcaggtttagaccttttttgattttaatcatatatttgcattacttgtgatggttaaggtaaaaacggcgtgttttgataccgtgtcgcgtggcatcaaaagcattgaataaattaatgtagcaaagtgttagattctatcaggaattgtacctgtttgtcagatttgctgcttttttccttgcggaagccgtttttatagtggattaaatttaaaccagtacggcgttgcctcgcccttgccgtactatttgtactgtctgcggcttcgtcgccttgtcctgatttttgttaatccactataaattgtcggaaggggggatattgatttgattatgccggaatttaaaatgccgtctgaatgttcagacggcatagcgtttacagcagtttgaaaacgaaaaagataagggtatgtacgatgaagacgggtgtcaggaaggcgaccgaccacatcatatagccgaagaaagtcggcatcggtacgccgcgctgttcggcaatggccttgaccatgaagttcggtgcgttgccgatgtaggtcagtgcgcccatgaataccgaacccatagaaaccgccagcagcgaatgaaacagggtacccgtcatcaaggcttgggcatcgccgcccgccatattgaaaaaaacgagataagtgggcgcgttatccaagaatgccgacaatatgccgctcatccaaaaatacatcacattaatcggatgacctgccgtatcgtgaaccagcgataccaccccgcccagcgcgcctgcctcgcctgctttcagaatgctcaggacgggaaagatggtgatgaagatgccgaggaagagtttgcccacttcggcgatgggttcaaagttgaattcgttgcctgcgcggacttgtttgggcgtgattgccatagatacggcggtcaatgcaatcaggatgacatcgcggacgaggttttgcagggcgtaacggctgccgaggatttcaaatcccgggtgttcgggtttccaaaggccggacattagaaccgcgccgaccacgcccgaaagcaggaggaagttccatttgccgaagatggcgattttttcgggtttttcctgttgtgccggcgtatcttgtgcaatgctttcctgtttgaagaaacggttgtcgatgaaatagaaggcggtcaacaggacagcggtgctgatcaggacgggggcgaacatatgtttgaccgtccacatgaaatctacgcctttgaggaagccgaggaagagtggggggtcgcccaaaggggtcagaccgccgccgatgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaatggtgatgccaggtatgcgaaaaaaacaagggacccaatgcgatagacagcaaaatcagggcaaagggcaggccccacagcaggtttaggtttgcgccgtccaaatctgcggcgtaaaccgatgctgggaaaagcattagtgaaaacaggggtaggtggcgcatcgtgtttcctcgattcaagcactgccttgcgcggcgcgtgggagtgatacaggcaccgtgccgcccggacataggcggactgtgctgcctgtttgtttttgaaaaaagttttccgattgattgtaaagtaaataatcaggataaaccagtttcccaaaccggaaggcggcgggaaggcggattgctgtgcttgggaatatatgttctttttgataaataattttatttaaaacaaataaatatatgtctttaataaataatctatcgaaaacgaaaaatgaatttattttaacatatatttgcaatgaaacaggtttgcccccccccgtttgtttgcccttatccctttcagtacggcattcaagattcgggcctgcgccacatccatatggcgacaagggaacaaaaaaccgatgaaaccgccccgacccaccagcgttggggaaactgccaaaacattatcaggcaggatgcggtcatcatactgatggcgaatattttggctttgcgcggcactgcgccgttttgttcccagttatgaaccatcgggccgaaatagcggtgccggtgcagccagcggtaaaagcgcggggatgcctttgcccagcaggcggcggagagcagtacgaacggcgtggtcggcaacagcggcaaaaaaatgccgatgatacccaacagtagggaaatgcagccgcaggcaattaaaagataacgtatcattttgaaatatttttcttattgtgcggataagggcaggatgtgataccgagttttgcccagccttcatgtcccattttttccagcagggcgatattgcgttcgaatattgccgaagcgtcgggaaaggcttgtgcggctttggcaatgctgtcttcgcggatgaggtgcagcgtcggatagggagaacggttggtgtagttgccaatgtcgtctgaatccgtgccttcaaattggaaatcgggatgaaacggggcgatttggacgatgccttctaagccgttttcgacaacggcggcatcggcaatgtcgagcatatcgttgaatacgtcgaaatcggggaatagggtcgggtgaaccagcagggtggtttccagttcggtggcgggtgtattgcccagtcgctgcagttcttcgtccaagtcttccaaaaaaccgtcaaggtgtttggcttcgctgatcgcgatgcggacaaggtttttaacgtggggggctttggcaaagggacacaggttcagaccgatgacggctttttccaaccattgtccggtgtgttcggcaacagcatctttattttcggaagtattgatattcattattgtcatgtaaatgtgtttgcagattgcacgtgcgggaaaatcgggaagggcactattccttcagcaggtggttgagcggcagggaggtggtgtgtttgatttcttttaaaacaaagctcgattgcgcatcttgtacgccgtggtgggacaggagcgtatccaaaacaaaatgggaaaacgcgttcatatcggtaaaaaacgcctgaagcaggtagtcggtttcccctgtcagggcgaagcagctcaagacttcaggccattttcgaaccgatgcggcaaagtcttcccgcgcgtcttttgctttgcggatggaaacgcggataaatgcctgaagtcccaagttgacagattccggagacagcagcgcggcatattggcggacgataccggcatcttccaactgcttcagacggcgcaggcacggagaaggcgaaagtgcgacacgttcggacagttcgacattggtcagcctgccgttttcctggagaacctgtaagattttaatatcggttttgtctaaagtgagttggggcatatttgcgttccgttttaaggaattcggattgtctgtccgtatgtttgcggcaatccgcacagatggagaccatattaacatataaaaagttataccgtcatccgggacaaattttgttttcggaaaatcatgtgaaaacagaggcggtcggtttgcatctctttaagacggcttgcccaaaccgccgattcaagacataatcgggaaatgtgcaggagagtgttacacccaactacaatgtaaccaccgaaggcgcagacacccttaaatcgctcaggtatcagggactgcacattgaaacaaacaatctggagagcggcgttggaataacgtccaccgaaggggagaaggccgtctgaaccaccattcagacaaccgcgcaaagcagtgagcagactggtttgccatcatgcggatacagccgaaaatctcaggttcaaggacagatagggtcatccgcgcacaggtgcgcgggcggcatctgaacaaaaaatccggagaaacttgagaatgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattgatgcggtttcagacggcattttcatttcatatgccgtctgaaagcaggttttaattgttgtccgatacggacgtttgtagaaagcattgaacaaggcatctgtggatattgattcatgcagatgccgtctgaaaataacccctatcaatggagtatcaaaccatgagcaacaacatcccggccgaactgaaatacgttgccagccatgaatggctgcgccttgaagaagacggtacgattaccgtcggcattacccaccacgcgcaagagctgttgggcgacatcgtgttcgtcgagctgcccgaagtcggcgcgaaccttgccgctgaagagcaagccggtgtggttgagtctgtaaaagccgcgtccgacgtgtacgcaccgattgcaggcgaagtcgttgccgtcaacgaagatttgccaagcgctccggaaactgccaacagcgatccttacggtgcaggctggttcttcaaactcaaaccggcaaacgttgccgattacgacagtctgctgactgccgaacaatacgcgggcgaagtggattaaaccgcccggctgcccgacggcaaccgccggacaaacggaaactgcaccttcagacggcatttttgcggtcggaggtgcagttttttgtccgtgttttaaggaagcagttaggctataataacggtctatattcatctttaccgattttttcatgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataacggtgcgccgggaaaaatgccgtctgaagaggtttcagacggcatttttttgtgccgcctgacaacatcgtgaaatcccacattatatcgatgtaatcacaaagtatagtggattaacaaaaatcaggacaaggcgacgaagccgcagacagtacagatagtacggcaaggcgaggcaacgctgtactggtttaaatttaatccactatattatcccgtatgcggattggttttaagatttgtaaatttgatttgcatcaaaaaatcgccgatagatgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcatttgcccgcgcccgggcgggcgatacgctcaaactggcttccggcgtatataaaaccaaacttcacattgacaaaccgattacgattgaagggcctgccgaccgttccgcaaccatcgaaggcgacaggagcgggcgtaccatagccgtacacgcgccggacgtaacgctccgcaacctgaccgttacccgttccggtatgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactagtctgcttcagacggcatccggattcaaatgccgtctgaaaacacaaaaggaacaaccatgaccacacatcatgtcgaattgaggaaggtaaccaaacggttcggggcgcaaaaagccgtcaaccaagtcgatttggttttgaaggcaggagaaagcgtcgggcttgccggacacaacggcgcgggcaagtccaccattatgaagctgatactcgggctgattaccccgaccgaaggcgaagtgatgcttttgggcgaacgtaccggtagcaaagcgggggcgcggcttcgcagccaaatcggctacctgcccgaaaccgttgcgctgcacccttcgctgatcggcatcgaaacgctggatttttatgccaaacttaaaaaacagccgctcacgcagaaccgggggctgcttgagcgcgtcggcatttcacaggcggcacaccgccgcgtcggcacttattctaaagggatgcgccaacgccttgccttggcacaagccctgctgggcgagcccaaagtcctgctgtttgacgaaccgacaaccggtcttgaccctgcatcacgacaaatgttttacgaagtcgtgcgcgaactcaacgggcgcggcgcgaccgtattgctcagcacccacgcccttgccgagttggacgggcacgccgaccgcattatcgtggattaaatttaatccactatatgcgggtatggcgggtttgagcggacaaatcagcctgaccgtccccgttttgctgaccgctcaggttttatgggttatcattccgcttgttttggcagccggaatttttagaaagcgacaaatatgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataatattgaaaaaaccggccgaaactttaaaaacgagtttcggtcggtttttcttttcttgttcggtatagtgtcggcaggaaagaaccttcacatcccgccgtaattcggcccgctcgcgccttcggggcaaatccaagtgatgttttgcgtcgggtctttgatgtcgcaggttttgcagtgcacgcagtttgccgcgttgatttgcaggcgcggattgccgttttcttcaacaatttcgtacacgccggccggacaatagcgcgtttcgggcgaggcgtattctttgtagttcacgtctatcatcgtttgcggattgttcagcaccaaatggtcgggctggttttcttcgtgcgcgagattggcaaggaagacgctgctcaagcggtcgaaggtcaacacgccgtcgggtttcggataatcaatcggcttacacgcggcggcttttttaagctgctcgttgtctttgccgtgatgtttcaaggtccacggggctttgcctctgaaaatcatctgatcgatgccggtgtagattgagccgaggtaaacgccccatttgaatgacggacggacattgcgcgcggcgtaaagctcttgatacagccagctttgttcaaaacgttgctgataatccgccgcctctttgccgctgtcgaaaccctccacttcttcaaggttttccaacaaggggaacacggcttcggcggcgagcatggcggatttcatcgcggtatgaatgcctttgatgcgcggcatattgaggaaacccgccgcatcgccgaccaaaatgccgcctttgaacgagagcttcggcaaactttgcaaaccgccttcaatcagcgaacgcgcgccgtaagcaatgcggcggccgccttcaaaggttttgcggatttcgggatgggttttgaaacgttggaactcttcaaacggcgacagataaggattttgatagtccaaaccgaccacgaagccgacggcgactttgttgtcgtcgaaatggtaaacaaacgcgccgccgtaggttttgctgtccagcggccagcctgcgctgtgcaccaccaaaccgggctgatgctgttcggacggcacttcccaaacttctttaatgcccaagccgtaagtttgcggctggctgttttggtcgagttggaaacgttcgatgatttgtttggaaagcgaaccgcgacaaccttcggcaaacagggtttgctgcgcccaaagctccatgccgggttggaatgaatcggtcggctcgccgtctttgccaatgcccatattgccggttgcaatgcctttgaccgaaccgtcttcgtgatacagcacttcggcggcggcaaagcccggatagatttccacgcccatattttccgcctgctccgccaaccagcgcacgacttcgcccaagctgacgatgtagttgccgtgattgtcgaaattcggggtaatcggcaggttgaacgcttttttctcggtcaggaacaacactttgtcctgcgttactgtgcgtgtcagcggtgcgcctttttctttccagtcggaaatcaactcattcagcgcaatcggatcgataactgcgccagccagcgaatgcgcccccacctccgaacctttctccaccacgcaaacgctgatttcgcgcccgttttgttcggcaagctgcttgagtttgatggcggcagacaaacccgacgggcctgcgccgacaatcacgacatcgtattgcatactgtcgcgggtgatggattctgtcatggcggttcctgtgtatttattattgaattgcaaatccgtaattatacaacgggaacatatagttaccaaatacaacaaaggtcgtctgaaaaccatattttcggttttcagacgacctttgtcgaaatttcaataagcacgccaccattttacctgtccgaccgcaaactccgtctgacgtttcggactgcgtgtgaaaaacgccttatccccgccggcatccctccctttcggcacaaccgccaaaatcttacctgccaaatttccctcacgggtttgccaagcatccaaaaactgcgccctgctcattgaaacatgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaaatttaaaccagtacggcgttgcctcgccttgccgtactatctgtactgtctgcggcttcgtcgccttgtcctgatttttgttaatccactataggtttccgtgcggacgtgttcagattcccgccttcgctggaatgacggcggagcgatttctacttttccgataaatgaccgtaacttaaaatcccgtcatccccacgaaagcaaaaatcccgcctgtcggatttcggtttttttgggcgtttcgggaaacttataaatcgtcattcccgcgcaggcgggaatccggtttgctcggtttcggtttttcgggcgtttcgggaaactgatgaatcgtcattcccgcgcaggcgggaatctagaacgcgggacggcggcaatattcaaaggttgtctgaaaattcagaggttctagattcccactttcgtggggatgacgggatataggtttccctacggacgtgttcagattcccgctttcgcgggaatgacggcggagcgatttctacttttccgataaatgaccgtaacttaaaatcccgtcatccccacgaaagcaaaaatcctgcctgtcggatttcggtttttttcgggcgtttcgggaaactgatgaatcgtcattcccgcgcaggcgggaatctagaacgcgggacggcggcaatattcaaaggttgtctgaaaattcagaggttctagattcccactttcgtgggaatgacgggatataggtttccctacggacgtgttcagattcccgctttcgcgggaatgacggcggagcgatttctgcttttccgataaatgaccgcaacctaaaccccatccttcccgcaaaaacagaaaaacaaaaacctaaaatcccgtcatccccacgataacagttgcgtaattgcgtagagtgggcttcagcccaccgttttttctttttcggtcgttgattggtgggctgaagcccacccttgtatatcggaactcccgtatcatagcaacaaaccgcccggccgccacccgcgcccacccaaggcacacaaccgttgcgtagcacagggagcggcagggcaacccatcgacacaaccggacagttgccggacaacacaaccgaatgtaaggcaggttgatgatgagtacccgataccattacgcaggtatagtgaattaaatctaaggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaagttctcaatgccgttaatgtggttctgacggtctgcacactccttggaatggttgatgcggtaatggataaaaccgctcacgtccaacttgtcgtagctgctcagactatcggtataaacaatactatccggcatgattttctttttgatgacagggagtaacgtttcagacttggcattatccaccacaacggtatagacccgtccgttgcgtttcagaatgccgaaaacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccaaaaatataccaaaaacagcaaaacaaattgtaaggatacgtataggctttgtaaaggtaaattgtgaaaaaagcagttttttaaacgaatgaaacggcttcgggctgaaatatatgctgatgccctgttcttcccgtatttctcgtgtgttgtcaaagtgcaggctgctttgaaatcggtattgccatctatgaaccaccactttgctttatttcagcgggcttgagatgtgtataagaatattgttttgaataaatttaaagaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggttcttgagccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcattgcaacatttcagccaatatgtagatctaattaatgaaaataatggtagattacctaacactagtgaaattgagagaagttactataaagccgttaccgaaaatggtgtttcttctagtgcagctattgatttagttattaatcgctcacttccggatatggcagatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgataatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaatttagagatctgttcccaaatccggaaggctggatcgatgatggtcaccaatgtttcgctccttgggttaaagaaactaaaaaacgcaatggcaaatatcatgtctacgacccccttgccctagatttggacggagacggcatagaaactgtcgctgccaaaggcttttcaggcagcttatttgatcacaccaacaacggtatccgcaccgccaccggttgggtttctgccgatgacggtctgcttgtgcgcgatttgaacggcaacggcatcatcgacaacggtgcggaactcttcggcgacaataccaaactggcagacggttcttttgccaaacacggctacgcggctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaattacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggcttcgtcgccttgtcctgatttttgttaatccactataattttcagacggccttttgccttttcaaattcaaaccaatcaaacggttttattgcttcatcgcgttggtcaaggctttgatgttgtggcggtacattccgatgtaggtgtctgcgggcgcgttgccgagtgcgtcggaatacagtttgccgctgacgttgacaccggtttctttggcgatacggtcaaccatacgggtgtccttgatgttttcggtaaagacggctttgatgccttcgcgtttgatttgtcggatgatggcggcgacttgtttggccgaaggctcggcttcgctgctcacgccttgcggggcgatgaattcgatatggtaacgtttgcccatataggaaaaggcatcgtgcccggtcaggactttgcgtttggcagcagggacggcattaaatgcggcttgtgcgtcgctgtgcagttttttgagctgcatttggtagttgcccaagcgttgttgataataaactttgccttcgggatcggcctttatcagggctttggcaacgttttgggcataggcggacataaggacggggtcgttccagacgtgcgggtcatattcgccgtggtcatggtggtgtccttcgtggtcatgatcgtggtcgtgatggtgtccgccttcttcttcggctttgaggggttggatgcctttggtcgcttcggtataggatactttgctttgtttgacggcgcgttgcacatcggcagcttcaagtcctaagccgttgagcaggacgagttttgcactgcggatttttttaatgtcgccactggtcatatgataggcgtgcgtatcttggttggctccgaccaaactttgtatggatacgcgctctccgccgatttgtttggctacgtcgcctaaaatgctgaagctggttacaaccggcaggggggcggcagttgcggaggcggtcagcaatgcggcaataagggtgagtttgaggtgtttcataactgttctcctgtgatataacgtaacatctgttatggtaaaacaagccgcctgtttgttcaagcggcttgcggggtcaggtggtgtggtggcggtggtttttgagccatttggtcagaatgccgccttctttgccgagtatgacggaaaagagataaaggacgctgcaacagaggatgatggcgggaccggaaggaatttcgatgtggtaggaaatgagcagtccgctcaagccgcacagcagggctgtcagaacggataggaggatgagtgcgcccatatgcttcgcccacaggcgggcggtaatggctggcagcatcatgagtccgacggacatgagtgtgccgagggcttgaaagccggatacgaggttcatgacgaccaggacgagaaagaggacgtgccaaagcccgcctttgccgccgacggatttgagaaacagggggtcgatgctttcgagtacgagcgggcggtagatgacggcaagggtaatgagcgtgaggctggagacggcggcgatgagctgcagggcaggaatatcgacggcaagtacagagccgaaaaggaggtggagcaaatcgacgctgctcccgtttttgctgacgaggactacgccgatggcgaggctgctgagataaaaggcggcaaagttggcatcttctttcagggtggtgaagcggctgacgagtccggcaagcagtgccatcagcatgcctgcggctacgccgcccaaacccatggcgggcaggctcaagccggcaaacatgtagccgacggcggcaccgggcaggacggcgtggctcaatgcgtcgcctatcaggctcatacggcgcatgacgaggaatacgccgacgggtgcggcactgagggacaggcagaagacggatgcgagggcgtagcgcataaagtcgaattctgcaaagggggcaaggagcaggtcgtagagattcatggtttttcggtttcagacggcatttatgaggcgcaccagtcggggctttcctgttgctgcattttggcgttggcttgggcgaggtagggttctgtcagaatggtctcggttgcgcctgccgcaattttttcgcgggcgagcagcagggtattgggaaagtaggcacggacttgttcgtaatcgtgcagtacggcgatgatggcgtgtccgccgcaatggcatttctgcaatacgtcgagaagctcgtaggttgtccgtgcatcaacggcattgaagggttcgtcgagcagcaggaatttggcattttgaaccagcattcgggcaaaaaggacacgctgaaattgtccgtttgagagataggcaatctgacggtcggcaaaccgttgcattccgacgcgctccaaggcttcgtgaacgcgttgtttttgagcggtatttatccctttgaaaaagccgatttcataccatagccccattgccgccaagtcgaaaacggtcataggctgggagcggtcgatatcggactgctggggaaggtaggcgatgttctgacgggtcaatccgtccagccggatgctgcctgtatcgataggctgcaatcccatcaaggatttgagaaaggtggatttccctgcgccgttgggaccgaaaaccgcccacatactatgttcttcaaaagtaatgtccacatggtgcacggcaggtcggcggcggtagctgacggtcaggttttcgacaatgatgctcatgcggatactgcccaaaagtaaacgccccataaaagggatacggcaatcagggcaaggatgaggcggaaggtcaatcctgatagtaaaagggaaggtgtcatgatgatttgcggttttgaaagggaaggcggtaaagcgtttatcgttatatggctgatatgatactgtataacgtttggtctgtaaattatgcttgaataggcgggagtgattgttaatcaaggtggatgaggggcaggcatatcgttgacttgccggcatcgcagcaataagaaatgccgtctgaaggttcagacggcattgggggaaaacggtttgaatcaacctttgcgtgcaggcagtttttctttgatgcgtgcagctttaccggtcaggccgcgcaggtagtacagtttggcacggcgtacgtcgccacggcgtttgacttcgattttttcgacggtcggagagtacagttggaaagtacgttcaacaccttcgccgctggagattttgcggacgatgaagttgctgttcagaccacggttgcgacgggcaataaccacgccttcgtaggcttgcagacggctgcgggtaccttccacgacgcgtacggatacgactacggtgtcgcccggtgcgaattcggggatttctttattcaggcgggcaatttcttcttgctcgagctgttgaatcaggttcattgtttttttcctaaattatgattggatttcccgttgctcttgccggatggtttctaagaggcgggattcctttgggattaaaacgcgcttttccaaaagatcgggtctgcgctccaaggtgcggcgcagcgattgttccaaccgccattccgctatcaagccatgattgccggaacgcaatacttccggaacagccataccttgaaattctaagggtttggtgtagtgggggcagtccaaaatgccgcttgagaacgaatcctgttcggcagactgcatatcgcccaatacgccgggtacgagcctcaataccgcatccatcagcatcatggcgggaagctctccgccggaaacaacgaagtctccgatgctgatttcttcatcgacgctgctttgcagaagcctttcgtctatgccctcataccgtccgcacagcagaatcagatgcggaagttctgccagttctaccgctttttggtgtgtcaagcggtttcccttgggggctgaggtagatgacttttgcagcttgggaggattgtgttttggcgtgttctattgccgcatgaagcggcggagccatcataatcattcccgggccgccgccgaacgggcggtcgtcgatgtagcccaatctgttgtcggcaaactttcggggattgactgcttcaaactgccagattccctgtctgttcgcgcgtcccgttacgccgtagcgggtaatgctgtcgaacatttcggggaaaatggtaactgcctggataagcatcagtagtccaaaccccagtcggcagtaatggtcttgctgccggtatcgacggtttcgatatattgggaaacgaacggaatcagaatctgcccgtgttctccgtcaatcatcaatacgtcgtttgcgccggtttccatcaggttgcttaccttgcctaaaacggtatggtctttgttgacaacggtcatgccgaccaagtctgtccagtagtattcgtcttcttctgtcggggcgaatgcttcacggggtatttcgatggtgtaaccgcgcaatgagaatgccaagtcgcggtcgtttatgccttcgaatttgacttggagttcgccgttgacgacttttccggcttcaagggtaacgctgatggttttgccgtccttgaccaaatgccactcggggtagtccaaaaggctgtcggaatattcggtgttggcggcaattttcaaccagccttttatgccgaatacgcctttgatgtagcccatggctacccggttttgagtgtctgtcatggcggcaaatgcggattaggcggctttttgttctttaatcagttttgcaacggagtcgctgacttgcgcgccttgtgcaatccagtggttcaggcggtctgcattgaggcggacgcgctcttgtttttcgttggctacggggttgtagaagcctacgcgttcgatgaagcggccgtcgcggcggctgcgtgagtcagtaacgatgacgttgtagaaggggcggtgtttcgagccgccgcgtgccaaacggataactaccattttgagtccttttgagaaaatcggatatatggaaactgccgattttaggttattttgtggtcggtgcgcaagtttttatttgttttttctgttgttttgtctgccgcaaggttcagatatgcgcggtacaggtttttttcggtgtccgattccttgagggtaaatcctgatttttcagcaagtttgatcatgggggtattggttttgagaatgtcggcactcatagtccggtagccttgctgtgcggcggtttggatgatgagttccatcattttctgtgccagtccgctgccgcgcatatgttccgccagtgtgatgccgaattcgcattcgttgcgattcaggcggctgtggcggacgacggcgacgatgttgctgtcggcatcctttgccgtccatgcggcttcacagtggtaatcggggttgcacaggcgtgccaacgtggctgcgggcagttcgttggtgtgggtcatgaagcgtgtgtaccgtgcttcgggaccgaggctgcggacgaactgctgtttggcttctgcgtcttcgggcaaaatgggggtaatggtaacggtcgtgttgtttcttagggacagtgttttggggtatgctgcgggatagggggcaagtacgttgggtacggctgctccggtttcggttttgctgccgagcagttctgcggcggcttcgcttgtgtggcggagaaattcggcggctgtcgggtttttgtgtttcaggtatgcggcggcactctgcatttttgcggcggcatgttcgagggtttgggcggctttgcctgtgttcttgcgtttgggcgtgtcgtgtgtttcgggtgtctttaagaggaaatcgctgctgtattgtccgccgttgaggttgagggtgatgccgagaatgtgttggcggtattcgggaatgacggtcagtgtgtgcaggaactggtcgagggtttgtgtgccgtcgagttcggcaaagcgggcaaggtggcggctgtcgagcgtggtaaacggcgggagtacggcagtggtttgtccgttgcagcgtgcggtcaggatgtcgccatagagggggtggctgtcgaattggaattgtacggcgttatgggtggtgtgccggtagggggggaggtgcagggcttcggcgagcagggaggggtttgccgctgcaagggcttttttgatgttttggggttgcggtgttttcagacggcatggctgcggcggtgcaatgtcgagctgtgcctgtttcagggcggcggcggtgttgcggtaggaaagggtgcggattgcctgagtgggggtgtcgaaatgggttatgccgtctgaaaaggggctgctgacgagcaggggtttggcggtctgttcggacaggcggataagggcgcgtgctgtttttttgtaatcctcgtgtccggagggactgaggatggttaggacggcttgggtgtcggggtgggcaagctgacgtgaggcgatgtcgtggcagattgagggtgtgggtgtgccggtcaggtgtccgttgcggatgtggtggggaaggttgggaaagtggagggtgaggttttttggcgcgtgcgcgtgcagccattcggcaggcgtgtcggacaggatgtcgagtcgggacaggggtggaaggtcggacagttgggcgcgcagtgcggcttcgaggtcgtcggcgttgaaactgacgaggaagttgcagtgtcgggcgaggcagtgcagtacggcacggtcggtttctgtcgtgcggcaggtgatgtggagaatcagcggcgtatggcgggtaaattggcggattgcgctgaacagtttgcgctgatcctcttcagggttgtggtgtaggacggcggttttggtgtgcaggctgtgtccgaagcggttgagccaatcggcggatgtgatggggctgatgccgggatgcaggctgatgtggcgggatgtgccttgacggagtttgttcaggatgttgtcgatttggcggctgacggcggcattgccggtcagtatggcggtatggcctgcggcgtatccgtcttgggtactgatgttgagtccgagtgagggcagttggatgcctgcggtggtgcaggcggtgatgttgagtccgttgccgtggtgtttgcggatggcagtttcggcggtgtgcagttctgcggcagacaggttgtcccagtcctgtatgaggatgatgtgtcggagctgctttttgcggcaggttttgaagagggtgtcgtaactgtcgggtagggtaacggcaataatcaggtctgcattgccggggattttgttgaggctggtgtaggcgggcagtccggctatggtgtggtggcgcgggtttacgggggtgatttttccttgaaagggcgtactcagcaggttgctgagtacacgttcgcccaggctgtacggttgttcgctcgcgcctatcaggatgatgtggttgggcatgaagaagtagcccggatcggtttgtgccgacatgatatattcctttgcggacggtatgtgcgtgatttttggagagacacccgctgtgtgtttgttttggggtaactgtttgtgcaatgccgtctgaagccggttcagacggtattatggtcagttcgcacttttttctgttttggaaccggtttttttcttgggcaggataaagcgcatccgcagaccgttcggtttgatgttttcggcgatgattttgccgcagtgctgttcaataatatgttgggtcaatgcaagccccagtcctgttccgggtttgttggcactggagtctgcacggtagaaagcggtgaagatgtgcgggagctgcatttcgtccacgccggggccgttgtcggtaacgtcgattatccagtgtttgtggtcttgtccgatgttgatcaggatggtgctgccttcgggactgtagttgacggcgttgcggatgacgttgtcgaaggcgcggtacaggtagctttcgttggcaaggatggttgtgttttcggggatttttccgtcggcagacagggtaaccgtttgtccgtttttctgggcaatgctttgattgtcttctaccaggttgcccaggaagggcaggagtttcaggctttctttttccaaagccatattggaagtttcgagacgggacagggttaacagttccccggccagcgtatccatgcgggtcagttcgccttccagccgtttgagatattgctcctgtttttggggctgcgcctgaatcagtccgacaattgcctgcatgcgcgcaaggggagaacgcatttcatgggagacgtgatggagcaggtggcgttctttggcaacgagtttttcgagtttttccaccattttgtcgaattggatggcaagatgggacaattcgtcgtcgcggtcgtcgacctgttgggagatacgggtttcaagttctccgtttgccaccctgtccatgccgttgcctaagattctgatgggtttggcaatgttgccggcgaggatatatgccatcagcagtccgacgatgatgatgaaggacaatatgatgagttcgtgccaaatcggggcgagcggcaggccggggatcaacagggggctgggcaggcggcgggcttggagtttgtcccagtctttggtgaagaacaggtattcttcgccgaagcggtcgtattcgatatggacgaggttggaatgcgggtgtccggcggcgaaaagccgggcgcgttcgatggtatagctgtcgatataccggttcaggatatcttttttctcgtcgccctgtataacgtacacgcccgatgagacggggctgtctttccattccgtcaggatttcgcgcgcacccgcgtccccgcgtgcccggaatgcggaaatgatgctgcccatcaaagtggtttcgatggtgcggcgttggttgaactggttttcggcaagggtgttctgcaccagccagaaagaaaaactcgccacaaagattgcacagacgataaccgcgcaaaatgtggcgaaaatgcgttggaacagtttcatttatctgtttatttcagtttttgacaaacaggtagcccaagccgcgtacggtttgaatcagagaggcatcgcccaacttgtggcggatgctggagatgtgtacgtcgatactgcggtcgaattttgccagcttgcggtcgagtgcttcgacggacagggtttctttgctgactacctgtccggcatggcgcatcaggacttcgagcaggttgaattcggtgctggtcagttcgagcggcatgtctttgacggatgcctggcgtttggcggggtacaggacgacatcgctgacggagatgctgttgggtgcgttgttctgttcgccgctgtgttgtgcgcggcgcaggatggcattgatgcgtgccaagagttcgcgtggtgtgcagggtttggggacatagtcgtccgcgcccatttccaagccgatgattcggtcgatgtcgtcgcctttggcggtcagcatgatgatggggacggtgcttcgggcgcgtacgtttttcaagacatccaagccgttcattttgggcatcatggaatccaatacgactacatcgtactgcccgctcaggatttcctgtacgcctgcttccccgtcgggaacgctgcggacgttcagaccttcggcgctcaggtattcggtcagcagttcggttagcagggcatcgtcatctacgagtaatacgcggctcatggtgtttccttttcgtaagggtatgccccgaccctgtttcgggcggggcgtgaaaagattgtttgacggtttatcttaacacggctgcaatgttttttgatagcgtatttccctaccggtttgctgttttttgcaatgtcttgcatggagctttacatttcgggcggtatccgcatccgccggcgcgggtcatttgcagggttttgcttccggatgaccgggcgcggcggcgaaggctttgcagtctttgagcagttcgggtagcagcggcgcccatacgggcagtttgcggatttcgtcggcgtatcggggcatcaggtaggggtaataggactgtgtcgcccgcatccattgttttgcttctgcaactttgccttgccgcatcaggtagagggcgatgcggtaggtggcggagtgggggcggtattttagtgatttgagggttgcttcttccgcccaagtctgggtttcggggtattccggcagggcgaagtttacgagggagaagtcggcataaaaggacagcatcggactgtttgcggaaatatagcgcaactcgttgattttccggttgagggttttggcactgtcgtcagtggcgggggaaaaggcgttaaccagccgggtgtatgtccagtccaagtgcagcaatcctgcgaatatggcggcggaggcggtcagtatgccgagattggcggcttttttgaaggcgatgccgtctgaagcctctgcgggggacaggaagagcatcagtccgaaagggatgaggaaatagacataccacaaaggatattcgagcatactgtggcacatactgacggcaagcgtgcagattaggaaaagcgatgcgggggtcagggggcgtttaagcagcccggcaatgcccgtcagcagggttgcggcaaccagaagcgtgccgctgattcccatctctgcaaggagttggaggacgatgttgtgggaatgggtgaacaagttgctgaggaggttgtcgtatatgttgtgctgttcggcattgatgaggaaggtttgttgggcaaaactgttccagccgtgcccgaatatcggggcggactggaaggcggcaagggctttattccattcgatttggcgcggcaagtctgtgaaaccgccgttggcgacgcgttcgacggcagtttcgtagcggatgccagtaaaggtttccagaatggtgttcatggaaaattggaacagcgcggtaaggaatacggctgcggctatgccgagcatcgtccgcctgttggatttgtccgaacggaaataccagaagggaaggatgagggcgatggcggctatgtaggtcaagatggtgcgcgagttgaccaaacctaaaacggcggtctgcataatcaggcagattacgccgagggcggcggggatttttcgttgtccgttgaggtaggcggcggcgagtatgccccacatgaggtagtgtccgaggttgttgcgctgcccgatgtgtccgattacgccttgcccgctgtaaacgatgatgttttgaaacagaggggtgtcttcccagccggcaaactggatgacgacgatgcaggattgaagcagggagccgataagcagcgaccaggcaaacagggtcacgatgcgttcttgtccgaagtgtgcgaccaagctccggcaggcccacgcgctgacggcgagcaagatgaaaatccaagagacgatgtcgttcataccggggtaaatcaggttcatcaggcgtgcctgaagataccaaaacgccgccattgcaaacagaaggaagctgatggcggggattttgacatcaaacagtttttttcctgccgtgaggaacaacaggacaatcaggccggctgcggcggcggcatcgtggtaaaagtcgggcgacggtttcagtttgagcgcgaaggtaaaggggacgatgcctatccaaaggaagcagggcaggatgtaaatcggcagtttggcggcggggtgcgcgccggatacggtcgtttcagcgggcattgtttgtttccttgtattgtttgacgaacgacaggcaggatatgaagaagatgatgctgaatactgcggaaagcgcggcgcaaatctgttctgcgggataggcgtcgaacaggcgcatgacggcttcggcaaagtaaatcagaaccagcatggagctgtattggtaagtatagattttctttttcaagatgcctgaaagcggcagacagagggggagggctttgagcgcgagccacgagccgcccgggcgcaacggtgcaatccacagttcccaggaaagggacaggattatcagtgcgatcaggctgaaagaggcaaggaggtaagcggtttgtctgttcacggcggtctttacggtttaagggcggacaagggggagcggtatcccaaatcctgcaacatcgaaacggtttcataaacgggcagtcccataatgccgctgaagctgccttcgatagattggataaagatgccgcctatgccttgtacggcgtaggcaccggctttgtccatcggctcgccgctttgcacataggcggaaatttcttccgaactcaggggcttgaaaacgacgcggttggtttggacgcggcttgacgttttgccgcgataatgaatgcagacagcagtcaggacggtatgttgtttgccggacaatcggtttaaaaattcgattgcttcggcttgggagcggggtttgcccaatatgatgccgtctgaaacgacgcaggtgtcggcggtaatcagggggaaatcgggcattgtgccgttggtttcgcaaaagagggtcagggcggttcggtttttttcttctgccatcctttgaacgtaagcgaaaggtgtttcgccggctttaacggattcgtcgatgccggcaggcagttggatgacgcggtagcccaactgtgtcaggatttccattcggcgcgggctgtttgaacctaaatagagggtattcaaaggtattccttaatctgttgcggtatgaggcggaggttcggacggcatagtgtcaggttgttgcaggcggccgtatgtcgccatcctgttctgaacgtggcgtgaaaaagcgtccgaaccaaatacctgcttcgtataagagaatcagcggaatggcaagcagggtttgtgaaatcacatcgggcggcgtgatgatggcggcaatgacaaacgcgccgacaatcacataggggcgggcgcgtttgagctgtccggttgttaccacaccaattttggttaacaggataacgacaatggggacttcaaacgttgtgccgaacgcaacaaacatccccaagatgaaggagaggtatttgtcgatgtctgtcgccatattgacaccgacaggggtaacgctggcaaggaatttgaaaatgacggggaaaaccaaaaagtaggcaaatgccatgccgatgaaaaacaggctgacgctggagaggacgagcggcgtaatcaggcgtttttcgttttggtagagtgcgggcgcgacaaatgcccagatttggtagagcgtatgcggcagcgaaattaaaaatgccgccatcagggtaactttgaccggcacgaaaaatggtgcgatgacatcggtggcaatcatgctggtgtctttgggcaggtttgccatcagcgggtcggcgataaaagtatagagttgttgggcaaacggcattaggccgaaaaagcagactaagatgccgacaaccgtccacatcaggcggcggcgcagctcgatgagatgctcgacaagcggttggacgggttgttcgttttgtgtttcggacaccggattgctctctttatgatttacggacgcgcaatttaggtttggcgcggtgtttcggacgaaaatcgcgtttgcggcttattgcctgtttgcgcagggaagtggtgtgcggaacaggcgtttcaacagcagtatcgatatagctgacttcgacggtctgtacgacgggtgcggcggcagaagcagtcaggtattcccgccatgcgcggtcttggtcggtttccgcgggttcggctgtactgccggtttgcccgctgtccccaagggtttcggcggaagcgtaggaacgttcggacggcataacgtcggaaatgccgtctgatagggtgtttgccgcatcgggaagcggattgccgttttcatcgacaccgaaatcggcaggtgtccgctgttcgggcagtttttcccaaggcttcagaccgtcggaaatgtcgtgcagattgccttccatatccgtaccggtttctttgaggctgtctcgaacctgagcggcggcagcttcaaattcctgctttgccttcctcagttcttccagttcgatttgagtgtcaaattcctgtttgacgctgccgacaaagcgttgcagcctgccgatgagccgtccggcggtgcgggcggcctcgggcaggcgttcggggccgaggacaatcagggcgataatgccgacaaaaaccagctcgcccaaaccgaaatcaaacataaattacgctttgtcttcgtcttttttgtgttcgattacatcgtctttttgggcttctttgccgtctgtaccttcgttcagcccctgtttgaagtcatgaaccgcaccgccgaggtctttgccgacgttgcgcagttttttggtgccgaatatcaaaacgacgataatcagtacgataatccagtgcgtcagagaaaaactgcccatgatgtatccttaagtaagtattaggggttgattgtgaaataacggtttatacgggtgtacccatgatgtgtatatgcaggtggaagacctcttgtccgccgccttttccggtattgatcagggttttgaagccgtctgccagtcctgccgctttggcgatttcgggaactttcaacatcattttgcccagcagcatctgatgttcgggcgcggcgtgtgccaacgaatcgaaatggactttgggaatcagcagcagatgaaccggagcagcggggttgatgtctttgaaacaaaccatttcgccgtcttcatagacggtttgcgccggaatgtctttggcggcgattttgcagaaaatacagttgtccataacggctccgatgccgtctgaaaagcggtcagacggattgaatgtgggaaagtgcggattttaatataaattcaagattctgtgcgagcggctttttcgaccagccccgacagcccctgacggcgcgcaagttcgtccaatacgtcttccgccttcaggtcgtggtgtgtcagaagaatcatggtgtgaaaccataagtcggcaacttcgtaaaccaggtgggacgggtttttgtctttggatgccatcaacacttcgcccgcctcttcaatcactttttttaggattttgtcttcgcccttatgcaagagctgtgcgacgtaagattcggacggattggcagattttcgctgggtgatggtttgttggatggcggatagtacggaatctcccatgattttccttctgtttgtttctgtttgttcggaatgataggctaaacggctgctctcgggcaatacgcctgttgcgcttcgttggaaaatgccgtctgagcgtttcagacggcatttgtgctgttgcaaatgtaatttgcttacaggtttggactcacaataattttaacggcggattcgttgttgtgaatcagacgctcgaagcctttggaaaccagctcgtccagcttgatgcgctgggtgatgaaaggctcaaggttgattttgccttcttcgaccagtttgatggtttcggcgtggtcgttgcagtaggcaatcgtgccgcgcacgtccaactctttcatcacgacgctgtggacgttgatggtggcggggtggctccagatggatacgataaccaaattggcggcaggtttgcaggcttcgaccaaagtatccaacactttgttgacgctggtgcactcaaatgccacgtccacgccttcgccgttggtcagttttttcacttctgcaacaacatcgacttcggacgggtcgaggatgtagtcggcaacgccggattcgcgcgctttgtctttgcgtgctttactcaactcggtgatgatgactttgatgcctttggctttcaacacggcagccaacagcaaaccgatcggacctgcaccgccgaccaatgcgacgtcgccttctttcgcgccgctgcgtacataggcgtggtgtccgacagacagcggttcgatcaaagcggcttgatccaacgggattttgtcggaaatcggatgcacccaacggcgtttgacggcgattttttcggacagaccgccgccgcagccgcccaagccgataaagttcatatctttggagaggtggtagttgctgccttctccggtcggtacgtcatcgcggatgatgtagggttcgaccacgacgtgttggccgactttgatgtcgtccacgccttcgccgacggcatagaccacgccggagaactcgtgtcccatcgttacgggtgcggactcgccggaaatcgggtgcggatgaccgcaaggcggaatgaaaatcgggccttccatgaattcgtgcaggtcagtaccgcagatgccgcaccaggcgacattgatgccgacagtgccgggggcgacggtcggttcggggatgtcttcgatgcggatgtcgcctttgtcgtaaaaacgtgctgctttcattgtaacgctccttgttttcaagtaggaataccgtctgaatctggcaggcggcggttgaaatgggaatggcgtgaagaagcttgaccgtttccagttgaatctgtttagatattttactacaagaggagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaagagatgtgtttaagcacgcggaaggctttctgtttgcgtcaggtcaaataatgatgtcgtctgaaaaccgaatcggcttcagacggcatttatagtggattaacaaaaaccagtacggtgttgcctcgccttagctcaaagagaacgattctctaaggtgctcaagcaccaagtgaatcggttccgtactatctgtactgtctgcggcttcgtcgccttgtcctgatttttgttaatccactatatgtcgtaacggtcggattgggtaggttggcgcacctgtccggttttcggtttggcaaaccgtttttttgttgggtccagtgttttctgataggcggttgcggcatcggatttgcccagccctgccagcacgcggatatgctcggcagcagattgtgccagaggttcaagggtgtagccgccttcgagtacggatatgattttgccggggcagcccgatgccgtctgaatgattttgtgtgtcagccaggcaaaatccgcctcgtgcaggttgagcctgcccgattcgtctagacggtgtgcgtcgaatcctgccgacagcagcaccagttcgggtttgaatgcggcaagtcggggtagccactgcctgcggacggcttcgcggaatgtgcggctgcccgttcctggcggcaagggcaggtgcaccatattgccgccgtcgggcatatcgttgttttcggggaaggggaaaaggtcggtttcaaacaggttgaaaaacaggatgcgcggatcgtctttgaatatttctgccgtaccgtcgccgtagtggacatcgaaatcgatgacggcaatgcgtttcaggcggtattcggcaatggcatgcatgacgccggcggcaacgttgttcagcaggcagaatccgccggctttgccgctgcccgcatggtgtccgggcgggcgggcggcgcaaaaggcatgccatgctttacggttcatgaccatgtcgactgcctgaactgccgaaccggcggcaaagcgtgcggcagacagcgatcctgtgctgattgcagtgtcgttatccaggcgggaaatcttgcctttttggggcaggcaagattccaaacggttcagatatttgctcgagtggacaagtgcgaggcgcgtatcgctgatttcttccgcctctatggtttggaggtgctgccaaataccggcgcggcgcaatgcctgctcgatgcagaggatgcggtcgggcgaatcgggatggtttgcgccgggttcgtgcccggcacaggcgggatgcgaaatccatgcggtgcgggcgtttttgcccaaaaaaaggcgcaacagtgcatagaatttcaagattaggcgggtcaaggacatgggtttgtggacgggcaggctgcggtatacggtcggtacggacggcaaacccgatatattgtttacggtcttatgttattatatacccctctcgattttcaaccatattagaaagaacggataaattatgaatcaagctgttgcacaatttgctcctttagtgttgattatggtggtgttctacttcctgatcatgcgtccgcagcaaaagaaattcaaagcgcatcaggcaatgcttgccgccttgaaagtcggcgacaaagtggtcttggcggcaggtttcaagggtaaggtaaccagagtcggcgaacagttttttaccgtggatatcggacagggtacaaaaatcgaggtcgaagtggaacgcaatgcgattgccgcaaaagtcgattgatttgtgccgacaagccgcatctggaaagcccgaatgcggcactttgttttgaattccaaccgaaggcttgaccatgttccgacacgcagggcggcatattcaggatgccgctttccggtcttgcctggctgggaagggtttttgcctcttctgaaatagcccgattccgacaccaccgaaagggtggggttccaaccattaaggaacaatgatgaaccgttatcctttatggaaatatctgctgattgtgttcacgattgcggttgccgcagtgtattcgctgcccaacctattcggcgaaacacccgccgtgcaggtatcgaccaaccgacaagccatcatcatcaacgaacagactcaattcaaagtggatgccgcgctgaaaaacgcaggtattcagaccgacgggatgtttgttgtggacaattcactgaaagtgcgtttcaaagacacagaaacgcagcttaaagcgcgcgacgtcatcgaaaacactttgggcgaagggtatattaccgcgctcaacctgttggcggacagccccgaatggatggcgaaaatcaaagccaatccgatgtttttgggtttggacctgcgcggcggcgtgcatttcaccatgcaggtcgatatgaaagcggcgatgcagaaaacgtttgaacgttattcgggcgacatccgccgcgaactgcgccgcgaaaaaatccgcagcggcacggtgcgtcaggctggaaacagcctgaccgtccctttgcaggatgcaggtgatgtgcaaaaggctctgccgcagttgcgcaagctgtttcctgaagcaacgctgaattcagacggcagcaatatcgtcttgacgctttcggaagaggcggtcaataaagtgtgttccgatgcggtcaaacagaacatcactaccctgcacaaccgtgtgaacgagttgggcgtggccgagcccgtcatccagcagtccggtgcagaccgtatcgtcgtgcagcttccgggcgttcaggatactgccaaggcaaaagacatcatcggccgtaccgcgactttggaattgcgtatggtggaggacgatcctgccaagttgcgcgaggcattggaaggcaacgtgccgagcggttatgagctgctttcaagcggcggagatcgtcccgaaattctgctgatcagcaaacaggtcgagctgacgggcgacaacatcaacgatgcgcaaccgagtttcgaccaaatgggcgcacctgccgtcagtctgagcttggacagcgcgggcggcagcattttcggcgaactgactgccgcaaatgtcggcaaacgcatggcgatggttttgatcgaccaaggaaaatccgaggttgtaaccgcgccggttatccgtactgccattaccggcggacgcgtggaaatttccggaagcatgacgacagccgaagccaatgatacgtctttgctgttgcgtgccggttctcttgccgcaccgatgcagattgtcgaagaacgtaccatcggtccgtctttgggtaaggagaacatcgaaaaaggcttccattcgactttatggggttttgccatcgttgctgcattcatggtggtttactatcgtctgatgggtttcttttctaccattgcattgagtgccaacatactgttcctaatcggtattttgtctgccatgcaggcaacgttgacgttaccgggtatggccgcgctggcgttgactttgggtatggcaatcgactccaacgtcttgattaacgaacgtatccgcgaagaattgcgtgccggcgtgccgccgcagcaggcaatcaatctcggtttccaacacgcatgggcgaccattgtcgattcgaacctgacttcgctgattgccggtatcgcgcttttggtattcggttccggcccggtacgcggttttgcggtcgtacactgtttgggtattctgacttcgatgtattcatccgtcgtcgtattccgtgcgttggtcaatctgtggtacggacgcagacgcaaattgcagaatatttccattggttcggtgtggaagccgaaagccgaaatggcaggaggcaaggagtaagctatggaactctttaaaatcaaacgcgatattccgtttatgagctacggcaaactgacgaccttcatttcgttggttacgtttatcgctgccgtgttctttttggttaccagaggtctgaatttctctgtcgaatttaccggcggtacggtaatggaagtccaatatcagcagggtgcggatgtcaataagatgcgcgaacgcctcgatacgctgaaaataggtgatgtacaggttcaggcattgggtacgaacaaacacatcatgatccgcctgccgaacaaagaaggtgttacttccgcacagttgtccaatcaggttatggatttgctgaaaaaagacagtcccgacgttaccttgcgccaagtcgaatttatcggcccgcaagtcggtgaggaattggtaagtaatggattgatggctttaggttttgtcgttatcggcatcattatttacctgtcgatgcgttttgaatggcgttttgccgtatctgccattatcgccaatatgcacgacatcgtgattattctcggctgctttgccttcttccaatgggaattttcgctgaccgtcttggcgggtatccttgccgtattgggctattctgtgaacgaatccgtcgtcgtcttcgaccgtatccgtgaaaacttccgcaagccggcgatgcgcggacatgccgtgccggaagtcatcgacaacgcgattaccgcaacgatgagccgcaccatcattacccacggttcgaccgaggcgatggtcgtatccatgctggtgttcggcggtgcggccttgcacggcttttctatggcgttgaccattggcatcgtgttcggcatttattcttccgtattggttgccagcccgcttctgctaatgttcggtttgagccgcgacaatatcggtaaagaaccgaagaagaaagaagaaatcgtggtttgaagcgcatatgccgtctgaacattgccgtctcaagcagacaatgcttcagacggcatttttaacggttacttccacggtcttaaaatattgtgcagaaatgcgggaattgtgtcataatgccacgttgtcctatcttgggcatagggagtttgccgttgtcttcaggcttggcaaacttgtctgaatccctatggggattcttatatttttggagttttcattatggcactgaccgtagaacaaaaagcacaaatcgttaaagatttccaacgcaaagaaggcgacaccggctcttccgaagtacaagtcgctctgttgactttccgcatcaacgacctgaccccccacttcaaagccaaccccaaagaccaccacagccgtcgcggcctgttgaaaatggtcagccaacgccgccgcctgctggcctacttgcgccgtacccagcccgatacgtatcgcgcgttgattacccgcttgggtctgcgtaaataattacgctttccgacaccgcccagaaaaatgggcggtgttttcttttctgttgctttccgacaagctcaaatccatatttatagtggattaaatttaaatcaggacaaggcgacgaagccgcagacagtacaaatagtacggcaaggcaacgcaacgctgtactggtttaaatttaatccactatattgcccgaaaaccgcataaactaatataatataaagttctttggaatcttgttccatttcatgctgcccgtgcgctttacaagagtttcagacggcatcaaacgtttaactcccgccagcaatcaaacagctttttatcacccattcgaaaatccgttttgccggtactcgtctttttattggagtattgccattatgaccgcaaccactgcgtcttcagccaaaccttatctcaaaatccaaggtttggtgaaaaagtttggtgacaattacgctgtcgataacatcgacttggacatttatcaacacgaaatcttcgcccttttgggcagttccggcagcggaaaatctacactgctgcgtatgctggcgggtatggaaagtcccaatcagggaaaaattatccttgatggtcaggatattaccaaacttgcaccctatgatcgccccatcaatatgatgttccaaagttacgcgctttttccgcatatgaccgtagaacaaaacattgccttcggtctgaaacaggacaaaatgcctaaaggcgaaatcgccgcgcgcgtcgaagaaatgctccgcctggttcagatgaccaaatttgctaaacgcaaaccgcaccaattgtccggcggtcagcagcagcgcattgctttggcacgcagtctggcaaaacgtccgaaaattctactgctggatgagcccctcggtgcattggacaaaaaactgcgccaacaaacccagcttgagttggtcaatacgctggaacaagtcggcgtaacctgtattatggttacgcacgaccaagaagaggcgatgacgatggcgacccgcatcgccattatgtctgacggtcagttgcagcaagtcggcacacccagcgacgtgtacgactatcccaacagccgcttcactgccgagtttatcggcgaaaccaacatctttgacggtgtggtgattgaagatcatgccgactatgccgttatcgaatgcgaaggtttggaaaaccacgtccgcatcgatcacggtttgggtggtccgagcgagcaggacctttgggttagtattcgaccagaggatattgatttatataaagaaaaacccgaatatttgggcgactacaactgggcgaaaggcacggtaaaagaaatcgcctatttgggcagcttcgccatttaccatatcaagctcggcaacgggcgcgtcgtcaaaagccaagtccccgccccttactggtatgtgcgcaacattacaccgccgacttgggacgaaaccgtctatatcagctggccggaaaaccaaccgactccgttgttccgttgatttaaggggaatgcaatgaaccttaataaactgaaaaacaaactgttccgccgtccggggcagcgtgcggtgattgccgtaccgtatatttggcttttggtgctgtttctgattccgttcgccatcgtgctgaaaatcagctttgccgaacaagaaatcgccatcccgccgtttactcctttaacgacgatagatgaggatttgggtcgtctgaatattgctgtcagctaccaaaattatgcagacatcttccaaaatttttggagtacgctcaatccgttcggcgacggtgaaaacagcaatatctatctgatgacttattggtcttcaattaagactgcgctgactacgacggtaatttgtctgttggtcggttatccgaccgcctatgcgatttctcgtgccaatccttctgtccgcaatggtttgctgcttgccattatgctgcccttttggacatcgttcctgttgcgcgtctatgcgtggatgggtctgctcgggcataacggcattgtaaacaacctgttgattaaaatgggtattatcagcgagcctttggatttgttctacaatgccttttcgctcaatttggtgatggtttacgcctatctgccgtttatgattctgccgctatacacgcaactggtgaaactcgacaaccgcctgcttgaagcggcttccgatttgggcgcggggccggtcaaatcgttcttgacgattaccctgcctttgtcgaaaaccggcattattgcaggctccatgctggttttcgtccctgctgtcggcgagttcgtcattcccgagctggtcggcggttcggaaaacctgatgattggtaaagtcttgtggcaggcgttcttcgatcaaaacaactggccgctggcttccgccgtcgccgtcgtgatggtcgcgctgctggtcgtgccgattgccctgtttcagcattatgaaaaccgcgaattggaagaaggagccaaataatgcagaaatccaaattatcttggttcttgaaactgatgttggcactgtcgctggcgtttctgtatatcccgctggttgttttggtcatctattcgtttaacgaatccaagctggtaaccgtttggggcggcttttcgaccaagtggtacggcgcattgctggaaaacgacaccatcttggaagccgcttggctgtcgctgcggattgccgttgtgtcttcgcttgccgccgtcgttttgggcacgctggcaggctatgcgatggcgcggattaaacgttttcgcggcagtaccttgttcgctggcatgatttccgcacctatggtgatgcccgacgtgattaccggtctgtctatgctgctgctgattattcaggtacagatatttttgcagggcagcgaatggttacaacatctctacttcgatcgtggctttttcaccatcttcctcggacatacgacgctgtgtatggcgtacattaccgttgttatccgttcgcgtctggttgagcttgaccagtcgctcgaagaagccgcaatggatttgggcgcgcgcccgctgaaaatcttttttgtcatcactttgcctttgattgcccctgccatcgcttcaggctttctgctcggcattaccctgtctttggatgatttggtgattacctcattcctctccggccccggttcatccacattgccgcaggtgattttctccaaaatcaagttgggtctcgatcctcagatgaatgtcttggcgaccatcctaatcggcatcatcggaacattggtcatcatcgtcaattattggatgatgaggcaggcaaccaagcgtgaccgagaagcggcagaagcctaccgccaggaaaaattggctgccgagaaagcaaattaattaataaggcaggctgaccgcatgactgggtcagcctgttttcttcaaccgattttctgtttggacgatatggcccgacagcctgtatcattccgtccgaaaatacacctgataaagcaaacacaatgattcgccctgattttcaagaatatctgccttcttattatttcagttcggttaatcctcatactgtttatccgaaacttcaatgccgtctgaaaaccgatacctgtatcatcggcggcggattgggtggtttgtgcactgcattgcccttggcggagcagggacatgaaacggttgtgttggaagccgcgcgtatcggtttcggcgcgtcgggacggagtggcgggcaggttatcagcgattacgcctgcggtatgggggaaattgaaaaacaggtcggcttggagcaggcgcaatggttttggcaacagtctttgcaggcggtcgaactggtggacgaacgcgtccgcaaacatgccgtcgattgtgattggcagcgcggttatgccacggttgccgtccgtccgcagcattgggaagagttgcagcagtggcatgaacacgcccaacggcattacggtgcgagtcattatcaactttgggataaagccgagttgaaacagcagcttgacagcgatatgtaccaaggggcacaattcgaccccttatccggacacctgcatccgctcacttacactttgggcatcgctcgtgccgctgccgaagccggtgcgcagattttcgagcaatccccgatgacgtgcatcgaaccgcatcaaaacggttggctggtttacacgcccgaaggcagcgtcgagtgcaaaaatgtggtctatgctgtcaatacttatgcaggtttgaacccgatattccggcctttggaacgcaaggcgattgctgtcagcacctttattattgcgaccgaacccttgggggcgcgcgcaaaagggcttatccgtaacaatatggcagtatgcgacaaccgccatattttggattattaccgcctcagcgcggacggcagactgcttttcggcggtaaggataacgagtttatcgacaatcctgagcgtatgaccgagcttgtccgccaagatatgcttaaagtttttccgcagcttgccgatgtcaaaatcgaatattcgtggggcggggagtgcgacattaccgccaaccttgtcccgcatttcggacgtttagccccgaatgttttttatgcgcaaggttattccggacacgggatggcgataacaggcattgcaggtctggcggttgccgaagcaattttaggggacgaatgccgtctgaagccgtttgagcggttgcgccagccgaatattatcctgcaaccgtttttgcgcaaactcggttctttcctcggctcgaaatattatcagtggaaagacagccgttaagcgtcgcaggcagtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatgtttatccatcggcggcaaacgtgaaaaatgccgtctgaaacccgattttcaggcttcagacggcatagccgcccttattccacgcgttcgccgtggatattcagatccaaaccttcgcgttcgacatccttgccgacgcgcaggccgccgcagattttccccacgaccttcaaaatcgcccaactcattagcccgctgtatgccgccataacgaccccgtcttttacctgtatccacaactgctgccaaactgccgcatccccgccgaaaatgcggttgtcgaaaaagatgccggtcaatattccgcccaccagcccgccgaatccgtgtatgccgaaagcgtccaaagaatcatcgtaacgcaatttgtgtttgacgacggtgacggacacaaagcacgcggcggcagtcaatataccgatggcggccgcgcccgacgggccggtaaagccggcggcaggggtgatgccgaccagaccggaaaccgcgccggaagccagccccaaagcggaaggtttgtgtcccgctattttttcgcaggcaagccagcctgccgcgccgaatacggccgacacctgcgttaccgccatcgccatacccgccgccgcgtctgccgcaagcgccgatccggcgttaaagccgaaccagccgaaccacaacattgccgcgccgatcagtgtcatcgccatattgtgcggaggcatcgcctcgcgcccgtagcctatgcgcctgcccaaaaccaaggcggcgacgagtcccgcgataccggcattgatgtgcaccaccgtaccgccggcataatccaatacgccgcccttgctcataaagccgccgccccacacccaatgcgcgcccggcacataaaccaataaaaaccatatgcccgaaaacagcatcattgccgaatatttcatccgttcggcaaacgcgccggtaataatggcggtcgaaataatggcaaacgtcatctgaaaaaacataaataccggttcgggaacagtcggcgcattgggcgacacggtcagcatctgtgcggtagcgtctatctgcatcccgcttaaaaatacgcgccccaaaccgccgataaaggcatttcccggcgtgaacgctaaagaatagccgacggcgacccaaaggatgcccaccaatgtcgcgatggaaaagctgtgcatcatcgtcgagagcaggttttttttccgcaccataccgccgtagaataaagccagcccgggaagcgtcatcaacagtaccaaggcagccgcagtcatcacccaggcggtatcgcccgaattgacggcggaataaggcttccaccagtttaaaggttctgccgatagggatgccggcagcaaagatgccgcccatatgtgttttttcattttgactaaagtttccttaatggttgagcccgtctttcggaaaggcggggtcggggcttgtccgggagggacgcaagccctgccggaccggggcggcgcggggattttgccgatgtgccgccaatcccttgtttgaatatggaaatatcgcatccgatcccttgcacccgttgtccggcgggaggatttatccttaggcggcgcatatgtgggcgtatggattgtcaacaatttactgtaggaaaatatacagaggtttgggcgataaggcaaaatattgttgacaatatttttattttataaaattaatttattgattaatatattaaaaatttttaattggaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaatttatggggctgtcctagataactaggataaactcgattttactaattgttttaaaatggaaatttgaacttttatctcgctgttgttaaaacgtcgttcgtacccctttaaatacagctcaaaatgcgctttgggaatgccgtcaaacttgcgtaaatgacgttttgcccggttccaaaagttcccaattccattgatatggttttgtcgttcagcaaaataactttcatctgcttctacttcgccgtcaaacatttccaaatgcggactgttttgataaataagtaatcgtaaacgatgaaaataataggctgaggtacttttattaacgcctactaactctgctgctgttcttgcagttacacctgcgacaaacagttcaatgagtttattttgtttataccggcttagacgaatttttctcataggggcaactctaacttaatttgaatttccctagttatctaggacagccccaaatttatacaaaaatgagtgcggttcggcgcaaccttgaatcaagttcccgcatcggttttcattgccggtacggatgcgttcaagccggctttgcaaaggccgcgctttcggcaagcggacacggacactgccgacggttgcgccgttaacggggggagggaggagctgcgccgaccgtgtgaatgaaagtgccgtctgaaacccgattttcaggcttcagacggcatttcgcattaatgcgggcggcgcgtttatttgccgcgcatcagttcaaagaaatcgtcgttgtttttagaggctttgattttcccgattaaaaattcggctgcctcgatttcgtccatcgggtgcaggaacttgcgtaagagccacatacgttgtaactggtcgtttgggacaagcagctcttcgcggcgcgtgccggatttgttgatgttgatggcggggaagaggcgtttttccgccatacggcggtcaaggtgcaattccatattgccggtgcctttgaattcttcgtaaatcacatcgtccatacggctgccggtttcaaccaatgcggtggcgatgatggtcagcgaaccgccttcttccacgttgcgcgccgcgccgaagaaacgtttgggacgatgcagcgcgttggcatcgacaccgccggtcaggattttgcccgaggtaggcacgacggtattgtaggcgcgggcaaggcgggtaatcgaatccagcaggatgaccacgtcttttttgtgttccaccatacgcttggctttttcaagcaccatttcggcaacttggacgtggcgttgagccggctcgtcaaaggtggaggagactacttcgccacggacggagcggctcatttcggttacttcttcgggacgttcgtcaatcaagaggacgatgagttcgacttcgggatagtttgcggtaacggcgtgggcaatgttttgcagcatcacggttttaccgcttttgggcggggcaaccaagagggcgcgctgacctttgccgataggggaaatcaggtcgatggcacgtccggtcaggttttcttcggactttaagtcgcgttccagcttcaactgttcggtcggaaacagcggggtcaggttttcaaacaggattttatggcggcatacttccgggtggtcgccgttgatggtatcaagcctgaccagggcaaaatagcgttcgttgtcttttgggacgcgcacgcttccttcgatggtgtcgcccgtatgcaggttgaagcggcggatttgggtgggcgagacatagatgtcgtcggggccggcaagataggacgtgtccgcgctgcggaggaagccgaagccgtcgggcaggatttcaagcgtgccggagcaggtgaaaccctcgccttttttcatcatctggcggacgatggcaaatacgaggtcttgtttgcggaatcggttggcgttttcgatgccgtgttcttccgccaattctaagagtttggaaatgtgcagggtttgtaattcggagacgtgcataataatgatgtattttgaagaggaaaaagacaggcagatgccgtctgaaagaagaagctgaccgttgccggttgctcggggaagggggaattgtaggcagtcggcgcgtgggtgtcaaatattatcgcggacggggcatcggcaggaaatgccgtctgagcggagctgcttggaaaaaaatacccccgcgcttttcaggctcgggggtatgggcattgattatttgttcaattcattcgccaaatatagccaagtttcgatgacggtatccgggttcagggaaacgctttcaatgccttcctcaaccagccatttggcgaagtccggatggtcggacgggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggcttcggcttcgcccaaagtgcggacgaacggaatcatgatttcaacgttggtcaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaaggctttggggtggataccgatttggcggttgatgataaattccatacgcgccaagccgatgccttcgctgggcaggttggcgaagctgaatgcgagttcgggattgccgacgttcatcatgacttttacaggtgctttaggcatattgtctaaggcgacatcggtaatctgtacgtccaacagaccggcatagataaagccggtatcgccttcggcacaggatacggtaacttcttgaccgtttttcagcaattcggttgcattgccgcagccgacaacggcaggaatgcccaattcacgcgcgatgatggcggcgtggcaggtacggccgccgcggttggtaacgatggcagaagcacgtttcatcacgggttcccaatccggatcggtcatgtcggtaacgagtacgtcgccggcttcgacggaatccatctcggaagcatctttaatcaggcgcaccttgccctgaccgactttctgaccgatggcgcggccttcgcataatacggttttgtcgccgttgatggcgaagcggcgcaggttgcggttgccctcttcttgggattttacggtttcgggacgggcttgcaggatgtagagtttgccgtccaagccgtcgcgtccccattcgatatccatcgggcggccgtagtgtttttcgatggtcagtgcgtaatgcgccaactcagtaatttcttcgtcggtaatggagaagcggttgcggtcttcctcggggacatcgacgttggttacggatttaccggcttctgctttgtcggtaaaaatcattttgatgtgttttgaacccatggttttacgcaggatggcgggcttgcccgctttgagcgtgggtttgaacacataaaattcgtccgggttgaccgcaccttgtacgacgttttcgcccagaccgtaagaggaggtaacaaagacgacttgatcgtagccggattcggtgtcgagggtgaacatcacacctgatgcgccgctgtcggaacgcaccatgcgttgaacgccggcggaaagggcgacgatgtcgtgttcgaagcctttgtggacacggtaagaaatggcacggtcgttatacagggaagcgaatacatggtgcatcgcttctttaacgttatccaagccgttgatgttcaagaaggtttcctgttgtccagcgaatgatgcgtccggcaggtcttcggcagttgcggaagaacgtacggcaacggaaatgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtaggcttcggccgtggtggcaaagccgccggggacgcgaacgcctttttcggtcagctgactgatcatttcgcccagcgaggcgtttttaccgcccacgcgttcaacatctgtcatacgcaggttttcaaaccagattacgtagttgtcggccatttgtgtgtccaatccaaaatatgttaaaaaagaaacaaatccgcgtgcttattttaagcgattcgttcctctgctgtcatgtgttttatccgttttaaaatcatgatgccgtctgaaaaattgcggtttcggcgtgtgtagcggtttgaaacttacagccggtatacttctttttttgggtattttctttgtaaaacaggtggtttgaataggttaatgttttttctgtttgatttttttgtttattttttaaaattttctgccaaaaaatactttatataaataattttatttcaaaattatattgtgtctgtttgggtgtaatccgaggtaggtgtgctgcgggtgctttccttgtgtctgctgctgctgttatgatgggattttaaacctgtgttttaaggatggaagatgagcagtccgcgccatgtgttttacatttccgaccgtaccggtctgactgctgagaatatcggcgaggcgttgctgaaccagtttggcaatctgtcgttcaaacgccatacgcatccgtttgtcgatacgccggaaaaggcgcgcgcggtggtggagaaggtcaatcggagccggcaggaaaacggtcagcgtccgattgcgtttgtcagtgtggttgatgacgaaatccgtcggattatcaaaggggcggatgcttttcagattaatttctttgagacttttttgggactgttggagaaggaactcaataccgaagccacggcatccgggcaggggcatcacagtatcggtaatacgaagcgttatgatgcgcgtatggaagcggtcaatttttctttgaaccacgacgacggggtcagcgataagaaccttcaggaagcggatgtaatcttgatgggtgtatcgcgttcgggcaaaacgccgacctgcctttacctcgccctgcaatacggcatccgtgcggcaaactatccgctgattcccgacgatttggaatcggccgatctgccgcgtatggtcaagccttatagggataagctgttcgggttgaccatccagccggaacgtttgcaggccatccgccaagagcgccgcccgaattcaacttatgccaaaatcgatacatgccgcagcgaggtggcggacgcgcagagtatgttcagacggcatgggattccgtttgcgaatacgacggataagtcggttgaggaattggcggtacacatccttcaggcgtgcaagctcaaacgcaggttttgacgggctttgattcggtttgaaggcggaactgccgtctgaaatcaggtttcagacggcagttttatagtggattaacaaaaatcaggacaaggcgacgaagccgcagacagtacaaatagtacggagccgattcacttggtgcttcagcaccttagagaatcgttctctttgagctaaggcgaggcaacgccgtactggtttttgttaatccactatatgtttgtggggcggatatttttcagggctgtattttgtccagacattcgagcagatcgagtggcgtgcggatgtggaaatccgcctgccatgagccggtatcgtcttcgggagcgatgtagccccattcggcgaggacggtcgtcataccggcgttgcgccccgcctgtatatcgcgttccgcgtcgccgacgtagagtgtgtgttgcgggtcggcgtggatttgtccgcacgcatacagcatgggtttgacgctgggcttgggctcgccgcaggtgtcgccgctgacgacgacggcgggtgggatgatgaagccgagtttggggacgagtttgtcggtgaagcgcatgggtttgttggtgatgatgccccatttgatgccgcgttttccgagttcggcgatgagttcgtttacgccgtcgaagagggtggtgtcttgggcgtagcggctgtcgtattcgtcaaggtattcggtgcgccatcgggcatagtcgggatggtcgggggtgatgcctgcgccgagcttgatcagtcctgccgcgccgtggctggcttgggtgcggatttcgtccatgctttttgcaggtagtccgtggcgggcgagcagggtgttgagtgcgccgccgaggtctagggcggtgtcggcgagcgtgccatcgaggtcgaacaatacggcttgtatcatgtgtgttccttttttataaagtgcgggacgaagggtttcagacggcatgtttattttgtttcaaaccctgctcgaaatcttccaacatatccaattcaaagcggctgaagcctgctttttcgcgcgcttcgatgttcacatagccccggaagataaacatatcgtaacgggcaatcaggctgcggaacagggcgacaggctccaaaccgcgttcgcggcaaaggtgttgataccaccggttgccgatggcgacgtgtcccacttcgtcgcggtaaatgatgtccaacacgccgcaggtttccgaatcaccgcgctgcgccaccttcgcgcgtatgccgggcgtaacgtccagcccgcgcgcttccaaaacgcgcggcactaaagccatacgcaacaaaggatcgtaggcggttttgtatgccatatcccataaatgattgtgtgcttcaaaatcgccgtaatcgaagccgaaagcgcgcagcctttcgcgcatcaggcggaaatggtacacctcttccttcgccactttcacccagtcgcggacaaactgaaacggcagcgtgcggaaacggtatgccgcgtccaaagccagattgatggcgttgaattcgatatgcgcaatcgcgtgcagcatcgccgcatagccttcggttgtgttcattttgcgtggcgtcagctgcgacggcgcgaccaaaacaggcttgtccggtcgtcccgcgcgggggaagtccgccggcggtgcgtttgtttccgccccgtccgcattttgaacggcggcaaacgcctcatccgtcagccgtcctttttcatctgggtcgcccgaaagcagggcgcgttccagcaaagcataaatatcgggtttcatctcaagtccgccgtgttcggaaaacaaatattatagcgtttaaaaaaaacaagatgaggcatataatctccgcgattcggcattccgcgcccaaaccgtcaaatatagtggattaacaaaaaccagtacggtgttgcctcgccttagctcaaagagaacgattctctaaggtgctgaagcaccaagtgaatcggctccgtactatttgtactgtctgcggcttcgtcgccttgtcctgatttttgttaatccactataacgcggcacacattaaagggcagcgtggcgcgccgccttttccggtgggcaaaaaatcagccctcggaaaacgcggtttgcaaaatgcaaaccgcccgtaacgccgcccgtatgattgttttgctgcgccgatactttacgccacactcatcccgacaaggaaaaataatgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaaaccgtccaaagcaaaaagaaaacccaaaccgcgcacggcacgttcaaaatcctgcgaccgggccttttcaaatgggaatacaccaaaccttacaggcaaaccatcgtcggcgacggtcaaaccgtttggctctacgatgttgatctggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactgatgccgtccgccccgatgccgtctgaaagccgccgaggcttcagacggcatttttacgcaggcggaacaatgtcccgcattaccgcccgatcgggcaccggaacggcaaaccggtgaaaattaacggttgcgccccggctgtttttgccgtttaatgcaaaccttgctgcaccaagggccaagaaagccgaccggccgcccccacagcttccgatgcaggcggcccgtccgtccctgcaatgttttttatttttgaacgaaaggtcgaaaaccatgaaaaaaacactggtggcggcggcaatcctgagcctcgccttgactgcgtgcggcggcggaagcgataccgccgcccaaaccccctccgccaagcccgaagccgaacaatcgggcaaactcaacatctacaactggtcggattatgtcgatcccgaaaccgttgccgcctttgaaaaagaaaccggcatcaagacgcgttccgattattacgacagcaacgaaacactggaggcaaaagtcctgaccggcaaatccggctacgacctgaccgcgccgtccatcgccaacgtcggccggcaaatcaaagcgggcgcgtatcagaaaatcgacaaggcgcaaatcccccattacggcaacatcgataaagatttgctgaaaatgatggaagccgtcgatccgggcaacgaatacgccgtcccctatttctggggcatcaataccttggcaatcaatacccagcaggtgaaaaaagcattgggtacggacaagctgcccgaaaacgaatgggatttggtgttcaaacccgaatacaccgccaaactcaaatcctgcggcatcagctatttcgacagcgcaatcgaacagattcccttggcgttgcactatttgggcaaagaccccaacagtgagaatcccgaagacatcaaagccgccgtcgatatgatgaaagccgtccggggcgacgtgaaacgcttcagctcttccggctatatcgacgatatggcggcgggcaacctgtgtgccgccatcggttacggcggcgatttgaacattgccaaaacccgtgccgaagaagccgcaaacggcgtggaaatcaaagtattgaccccgaaaaccggcgtgggcgtgtgggtggattcctttatgattccgcgcgacgcgcaaaacgttgccaatgcccaccgctatatcgactacacgctccggcccgaggtggcggcgaaaaacggcagcttcgttacctacgcgcccgccagccgtcccgcgcgcgagctgatggatgaaaaatacacctccgacgcatcgattttcccgaacaaagaactgatggaaaaaagtttcatcgtatcgcccaaatccgcagaatccgtcaaactgggcgtgaagctgtggcaagggctcaaagcgggcaaataaccggaatccctgccgtctgaaacctttcgggcggcaggaaacggcgcgtccgttatcaaacaggggggcgtttcccctcctgccggttatgattgggttaagattaaaatgatttagtaaaatgagaaagatatggatttaagtatcgtagttcctatttataatgtcgaaagttatttggaagcgtgtttaagttccatagaatctatattaagtaatgaaaatgtcgaacttatccttgtgaatgacgggtcaaaagacggaagtgaagatatatgttacaaatatatagataaaatatcaaacagcaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaccggacaccaaatatcaaatatatatatcaggataaccaagggttgtcggaggcgagaaataccggaataaaaaattcaaacggaaaatatatagtctttattgattcggatgattttattaactgtcagattttgctggattttcttagtaaagatgatactgatatgccggatgtggtgtttttaaatgcggttaaatatgataagggaagtgtttcatattttggcgaagattatcagcctgaaaaaatactcaatcaatccaaagtcgaagttttgaaaggattatgccgatttagaaaatttccgggttcggcgtggaataagattataaaaagagaattgattattagagaaaaactgttttttgaaaggggaatttattctgaagatatcgaatggtcaatgaggttatttaatgcggcaacaactttttcttatttggacggttgttattactattatcggcagggaagaaaagattctattacgggaactgtttcggaaaaaagtataaagtcattattatatattttggagaaaaatgcggaaatggaatttaatagggatatatcgagttatctttattcttttctttcctacgaatatctcgttttgctttttataatgacgagtaaaaatatagagtgtgatgctgatataaaaagaagggcgtatcatttaaggtttatgctgttaaagtccaataaattgatatataagctgatattcccgataatcacattactcggggtcgatattacaggcaggattttaaaagcaatcagggggaatatttaataaatcctttaacaatatataccttaccgaaggaggaaaaatgaacgcaatccgaactttccaaaaccgcacgcccgaaatccacgaaacctgtatgatagacgaagcctgcgtcgtcattggcgaagtgtcgcttgccgaagatgtttccgtgtggccgtgcgccgtgttgcgcggcgatgtgaacagcatcaccgtcggcgcgcgcagcaatatacaggacggcagcgtcttgcacgtttcccacaaaaccgccgccaaacccgaaggatcgccgctggttatcggcgaagacgttaccgtggggcacaaagtgatgctgcacggctgccgtatcggcaaccgcgtcctggtcggcatggggacgacggttctggacgatgccgtgattgaggacgaagtgatgatcggcgcgggcagcctcgttccgccgcgcaaacgcttggcgggcggctatctttatgtcggttcgccggtcagacaggtgcgcgtgctgaccgatgaggaaaaagcctttttgaaatattccgccgcgcattatgtgaagctgtcgaaacagtacgggatgtgaaatcacatcggcgttcttgcgtcagccccaaattcatgcggatgggacgcatccgataacggtatccgatgcgccttgattttgaccgtctgcgtttgaattgcaggcaaaaatgccgtctgaaagccttttttcgggttcagacggcattttattgccgattgttttttaaagtttgaccgaatgttcgcgcgtttcgtggaacacgatgtccggccagcgttcttgcgtcagccctaaattcatgaggacgggatgcccgataacggtatccgatgcgtcttgattttgatcggtgcatttgagttgcaggcaaaaatgccgtctgaaagccttttttcgggttcagacggcattttatcgccgattgctttttacagtttgaccgaatgttcgcgtgtttcgtggaacacgatgtccggccaacgttcttgcgtgagtcccaaattcacgcggttgggggcgaggtaggcgaggttgccgcctgcgtcgatggcgaggttgcccgcgttggctttttcaaattcagccagttttttcttgtcgtcgcacgatacccagcgcgccgaccagatggatgcgctgtcgaacacggcttctacgccgtattcgttggcgaggcgcgaggtaacgacttcaaactgcaacacgccgaccgcgcccaaaatcaaatccgcgccgctcatcggtttgaacacctgcaccgcgccttcttcgccgagctgttgcaagcctttttgcagttgtttgattttcagcgggtttttgatgcgtacgctgcggaacagttcgggtgcgaagaatgggatgccggtgaacgccagttgttcgccttcggagaagctgtcgccgatttggatgttgccgtggttcgggatgccgataatgtcgccggcgtaggcttcttcaaccagctcgcggtcgtgcgacatgaaggtaaccacgctggaggcggcgatttcgcggttgatacgcaggtgtttcatcttcatgccgcgctcgaatttgccggagcagacgcgcaagaaggcaatacggtcgcggtgtttcgggtccatattggcttggattttgaagataaatccggaaaacttcggctcgtccggctcgaccatacgtacggtcgcgtcgcgcggtttcggcgcgggcgcccagtcaatcaatgaattgaggatttcctgaataccgaagttgttaatcgcagagccgaagaatacgggcgtgagttcgccggcgaggaattcgtcgagattaaactcgttggaagccgcctgcaccaattcgatttcgtcgcgcaactgctggatttccaacggaaagcgttgttccaattcaggattatcgatgcctttgatgatgtcgaactcgtgcggcaggcgttcgccgccagcttcaaagagataaatttcatcgttcaggatgtggtacacgcccttgaagtttttgcccataccgatcggccaggtaacgggcgcgcagcggatttttaaaatgttttccacttcgtccaaaagttccagggaatcgcgcacttcgcggtcgtatttgttcataaacgtaacaatcggtgtatcgcgcaggcggcagacgtttaagagcttgatggtttgcgcttccacgccttttgccgcgtcgatgaccattaatgcgctgtccacggcggttaaaacgcggtaggtgtcttcggagaagtcttggtgtcccggcgtgtccaagaggttgacggtgtggtctttgtaatcgaactgcatcacacttgatgccacggaaatgccgcgctgcttctcgatttccatccagtcggaagtggcgaatttgccggttttcttgccttttaccgtacccgcgctctgaatcgcgcccgaaaacagcaagagtttttcagtcaacgtggttttacctgcgtcagggtgggagatgatggcaaacgtgcggcggcggcgcacttggtcgaggatttcttgggacatggttttctttgcaaaaaggttcaggccgcttttcagacggcccggacagtgtttgagacggcgaaattgtacaaaaaaatgcctgataattcaatgttggaggcggtcagtgcgtgctgccgtaaatctctttttcgtctttcaggacggcatcggcggtttcccacgcgctgccacgccagactttgtaaaagcagctttctcgcccggtgtggcaggcgatgccgccgttttgggcgatgagcatcacaatggcgtcgccgtcgcagtcgaggcgcagtgcgcggactttttgcgtgtgtcccgactcttcgcccttcatccattgtttttggcgcgaacggctgtaatagtgggcaaagccggtttcgacggttttttgcagggcttcggcgttcatccacgccaccattaaaatacgtttggtttcggcatcttgggcgatggcgcaaaccaaacctttttcgtcaaatttgacggcttcaagcaggtttttatccatatttcctttcagacggcatagtcgaggcggtcagaggcgcacttcgatgccggcttcgcgcatagcgcgtttggcttcgcggatggcgatttccccgaaatggaaaatgccggcggcaagtacggcatcggctttgccttcggttatgccttcaatcaggtgccggacattgccgaccccgccggaggcgatgacggggatgtcgacggcttcggcaacggcgcgggtcagcggcaggttgaaaccctgtttcgtaccgtccctgtccataccggtgagcaggatttcgcccgcgccgcgtttttgcatttcgaccgcccattccaccgcatccaaaccggtcggatttcgcccgccgtgggtaaagatttcccagcgtgtgttttcggggttggcggctttggcatcgacggcggcgacgatggcttgcgaaccgaaaaatccggcggcttcgtcaattaaatcgggacgggtaacggcggcggtgttgatgctgactttgtccgcgccggcattgagcaggcggcggatgtcggcaacggtgcgtacgccgccgccgacggtcagggggatgaagacttgtccggcaacctcttcgatgatgtgcaggatggtgtcgcggttgtcggatgaggcggtgatgtcgaggaaggtcaattcgtccgcgccttcgccgttgtagcgtttggcggcttcgacggggtcgcccgcgtcgcgcaaaccgatgaagttcacgcctttgacgacgcgcccgtcttttacgtcgagacaggggatgatgcgttttgccagtgccataatcggatgcctttagtcgagggaatctgccagttgctgcgcttgggcaaaatcgatgctaccctcgtaaatcgcgcggccggtaatcgcgcctgctacgccatgtttttcggcggcacacagggcgcggatgtcgtccaagccggtcagtccgccggaggagatgacgggaatgcggacggtttgggcgagtttgaccgtcgcgtcgatgttcacgccgctcatcataccgtcgcgcccgatgtcggtgtagatgatgctgttgacgccgtcgtcttcaaagcgttttgccaaatcaattacatgatgcccggttacggttgcccagccgtcgatggcggccataccgtctttggcatccagcccgacaataatcctgccggggaaggctttgcacgcctcgcgcacgaagtcggggtttttgaccgccgccgtgccgataatcacgtcgtttaagcccaaatccaaatattgtccgatggttttcaaatcgcgtatgccgccgccgagctgtacggggatgtctttggcgacagcggcaaggatgtctttgatggcgggcaggttttgcggaacgccggcaaacgcgccgttcaaatctaccagatgcaggcggcgcgcgccttgtttgaaccagtgcagcgcggtttcggcgggcgaatcggaaaagacggtcgcctcttccatcagcccttgtttcaggcggacgcagcgtccttctttcaaatcgatggcgggtatcagcagcataatttttctccttgtgcggggccgtgtccggcttaccagtttaaaaagtttttcaacatcgtcagcccggcatcgtggcttttttcggtgtgaaattgcgtggcgaatacgttgtctttgccgacgatgcaggcaaacggggacgggtagtcgctttcgcccaatatggtttcgggattttcgggggcgaaatagtagctgtggacgaagtaaaaacgcgtgtcttggggaatatctttaaacagcgggtggttttgggtttggcgcacggtgttccagcccatatgcgggactttcagacggcatccctgcgggtcgcggaggtcgcgctcaaagcgtctgactttgccgccgaaccagcccaagccgtcggtgtttccttcttcactgtggtcgaataaaagttgcgcgccgacgcagattccgaaaaacggtttgttttttaaggcatctttgactgcctcgtccaaaccgtctcgttttaatgccgccatacagtcgggcatcgcgccctgaccgggaaaaatgactttgtcggcgcgggacacgcggtcggggtcgccgcttaaaaagatttcggtattttttccggcaagctgccccgccgtccggacggatttcaatacggaatgcaggttgcccataccgtaatcgataatggcggtttgcatggcttcctcctctttttttgcaatatggctgcgattttaacaaacaaatgtgccgtgctgataaaaatgccgtctgaaaacgggagtctgtcttcagacggcatagggtttaaacccggaaagccgtttgtcagccttccatttgttttgcctgaacggcagtcagggcgatggtaaacacgatatcttctaccagtgcgccgcgggagaggtcgttgaccggtttacgcaggccttgcagcagcgggccgacgcttaagacgttggcgttgcgttggacggctttataggtgcagttgccggtgttcaggtcggggaagaccaaaacggttgcctgtcctgccaccgggctgcccggagctttggatttgcccacacccggcacggttgccgcatcatattgcagcgggccgtcgatggcgaggtcggggcgtttttcccgggcaagtttggttgcttcgatgacggtatcgacatcggggccgctgccggagttgacggtggagtaggaaatcatcgccactttcgggtcgatgccgaaggcttttgcggaatcggcagactggatggcgatgtcggcaagctgttgcgcggtcgggttcggattaaccgcgcagtcgccgaagacgaggacttggttgggcagcagcataaagaatacgctggacacgaggcttgcgcccggtgcggttttaatcagttgcaaagcggggcggatggtgttggcggtggtgtgaaccgcaccggataccaaaccgtccacatcattttgcgccatcatcatcgtaccgagtaccacggtgtcttgcagttgcttgcgcgcgtcttcgggtgtcaggcctttggatttgcgcagttcgcacatcggctcgacgtattgttcgaccaatgaggcgggatcgatgatttccaaagagtcgggcaggctgatgccgcgttctttggcaacggcttcgacttcttcgcgtttggcaagcaggacgcagcgggcaatgcctttttcgtggcagatggcggcggcttggacggtgcggggttctgcgccctcaggcaggacgatgcgtttgtcggcttggcgggcgaagtcgatcaggttgtagcggaattgcgccggcgacaggcgttttgcttcgcggcctgccaatacggatacgtctttcagcgcgtcgctcgaaccgaagaaggtcaggccggttttttcggctgccgcttcggcaacggaggctgccgcgccgtccacgacaaaaccttccaatacgcccggcgcggcggcgaagaactgtttggcaaggttcacccgatttgccagttcgtcggcatcggcgttgtcggaacggacggcgaagacggctgccgcgtcaagggacaatgccagttcgacgtttttgcctgcgaggtagattttgtcggcatcgggcgcgatgccttcgatgacgaggttggcggcatcgagtgcggcaactttgccgaccagtgcgtcgaaccagtcgtcgcttttgccttgcgcgagcagggtttcggcggttgcgtcaacggcttggaaaatttgtgcgtccagtgcttttgcaaaggcttgtgcggcggcggaggcgtccagtccggcagatacgggtacgatgagtacttttgccatgatatatcctttcgtatgctgcggtgtgcggcatatgtggttggaaggggcggcatataggcagaaacggctgcctgcgtgccgtgcgtgccgtgtttggcttgaggcgcgcaggttgaatatagcaaacaaattctgtttccaacaagataaatatccgcaggcttgtggatgctgccgcctttcagagggtatttccggggaagaacagggcgggaccgtccaaatggaggacggcggaaatgccgtctgacagggtgggggcggaagggaggttgagcgtgaggacggtttgtccgacccggaggctgatttcggtatgccgcgctttgggcgtggttttgagaaccacggcgtgaatggaggcggtgggtgcggaatgggggtgaaggctgaactgttccggacggatgagcagtgtgccgcgtgtgcctgcgggtgcgccgctttgaacgggcaggcggcccaatccgcaatcggcggtgccgtcggcgttgagcgcggcggggaacacgatgccttcgccgataaacagggcggcatcaaggtcggcaggttgtcggtacaattcgtgagggcttgcagtttggaggatgcgcccctgtttcatcacggcaatccggtcggcgtattgcagggcttcttcgcggtcgtggctgacgaaaacggcagatttgccgttggcgcgcagggcggcaatcatgtcttcgcgaatctggcggcgcaactgttcgtccagcgcgctgaagggttcgtccaacaaaatcagttcgggatcgggtgcgagggcgcgggcgagggcgacgcgctgttgctgtccgcccgaaagttcgtgcggatagcgtccggcaagttcggaaatgccggtcaattccaacatagcttcgatgcgctgccgctcttgcgccgtcttgcctttgccgttgcccagcccgtaggcggtgttgcggtaaacggtcaggtgggggaacagcacaccttcctgtacgacataacccaaacggcgttcgcggacggggaggttggtatttttcgagaagatggttctgccggaaagcgaaatttcgccaaaatcgggttgttcaaaaccggcaaggcagcgtaaaagggtggttttgccgcagccggacgcgccgacgataaagaggatttcgcccgggtcgaggctgagcgaaatgtcgtttaaaactggggtgttttgaaaacttttggacaggtgtccgatgtgcagggcggcggtcatggcggtacttcctcaagctgttatttgaaggcgtatttcttcagcaggaatacggggatgccggaaaataataccagcatcagcgcgtaaggggtggcggcggcgtattgtgcgtccgatgtgtattcccaaacggcggtggagagtgtgtggacatcgtcggtggtcagcagcagggtggcggtcagctctttcatcagtttgaggaagacgagtgcgaatgcggcggtaatgccgggcaggatggacggcagtaccaacgtcctgaaaataaagaagtgtccgcgccccaatgttgcgccgacctgttccatcccttttgggagttgttccaaggaagtcctcagggtggtttgcgccatcggcaggtaaagcatgaaataggcaaggatgacgacgataaaggtttggtaaacggcaggggtgtagttgatgctgaaataaaccaaggatagggcgataaccaaaccggggacggcgtgcagtaaaaacggcagcctgtctatccaaacggttaaaaaattgcgatagcgaaccgatgcccaaacaaggggcaaggcacataatatagtcaaaatcgcacctaaagccgatacgcttaaggaacggataaaggcatcaaatacggatacgagcgcgaatgtgccggaagtgccgaccatcatccaatgtatcaatacgccaaaggggataataatgcccaaagtcaacaagctgcttaaaaaaacaatcgcgccaatctgaccgggcagtttgagggttttgacgggataaggacgggcaacgcctttgccgctgtggtaaatcttggctttgccgcgaaatatgctttctccaaatacgacgatgccgcacaccgccattaaaacagcggaaagcagggcggcggtattgttgttgtaggacatttcgtattcttggaaaatggcggtggtaaaagtggggtagttcaaaatggataccgcgccaaattcgaccagcatatgcagggcaatcagtaacacgctgctgccgatggcgggtttgagctgggggaggatggcggaaaaaaaggtttgcaggcggcttttgcccaaggacaggctgacttcttcgtaagacaggctgatgcgtttgagtgccgcctcgacgggcaggtaggcgagcgggaacgaggacaggctcataatcatcactgtcccccaaaagccttcgacacggaaggtcaggctgatccaggtgaaacagctgacaaatgcggggatgcacaaaggcagggtgattgccgtctgaaaaaaggttttgccgaagaagcggtaacgttggaacaaaagggcgcaggcaatgcccaaaacaatggaaatcagggtaacgcccgccatcatcgtcaaggtgttggagagcaaatcccacatacgcgggcggaacaacagttcgacggcgcggttgatgccgacctgccacgaacgcatagcgacatataaaaaaggcagggtaagcggtagggcaatcagtaggatgaggccggtaagccaaatgggtatttttttaggagacatagtgttttttatcggcaaaacgggcggacagtataaatgtccacccgtttgacaatccgaaaacggcttatttcataccggcttgctcaagcagccgggtggcgtgttctttttcggaaacagtggtggcggacacttggggtgcttccaacttggcgatgggttccaaattgaaagtggataccacgtgcggattcaaaggatattcggcacggacggcggtcagggcgcgctgtccttccttgctggcgaggaaggcgacgaattttttcgcctcatccttgttttgggaggattttaacacggctgcgccggaataggtaacgagtgcgccgggatctctgtggcggacgaaattcaggcgggtgtggacattttgtacgcctttttcacgcgcaaaagcgtgccagtagtagttgttgatgagggcggcatcgatttcgccgttttcaaccgcttgaagggcgacggagtttttagcgtaaggcttgccgtattctttcagacctttgagccatttcaatgcggccgcttcgcctttcagtttgacgatggcgacaacctgttccaagaacgcgccggaagtgggggcgtaaccgatgcggtttttccatttcggcgtggcgtaattcaggacggatttttccaaatctttttcagacagtttgcgggtgtcgtaaacgacgacgcgcgaacgtccgctcagtgccacccagtcttttttggcggcaaccggcacgcccttgccgcgtgtttcgttgatggtggaggcgggcaggggctctaggaggttggcggcggaaagggtggcgagtgccgggatttgttcggaatagaatacgtcggcggggcttcggctgccttcttctttgatttgaccggcaagctggtcgcctttggcgctgttgagtttgactttgatgccggtagcccgggtaaaggcatctgcaacggcttgtgctgcttctttgtgttggccgttgtacacggtaatgtctgccagcgcgggggttgcggcggtcagggctgcggcaagcagtgcgtatcggatagatgttttcatatcgattttctcctaatgaatgagagtgtataccttgttaagacataacggtgtgtagtgtattccttcttttttataaatgcaaataattattttttaaatttgttgttgtccgatccggttattgtttgttctgacttgtattttttccgtgagtctcgcccgtaaggcggaagtggcgggcaatgcgtggcggaatgtgggtaaaggcggcattttgatttgtcggaatgcttgagaacccctctctttaaaacacccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaccgtctgaacagggttgctggaatagtattgccatcccagcagatacagtttgtcggggtcttgccaatattgttcatccagactgttcagcagtgaggcggttttgttgtcgagatgttatatcccacatttctttcaggtttttaccttccgattggaggcggcggatttctttgtccaatgcgtctgccgcccgatggatcagcattgcgctgtgtaccgcgccgatttttttcagaacggaacaagtcttttcggcggcggggaaaccccagttgcagacaaattgcagtatgctgccgttaccgatatcggcttctgtccgccaaatcaaaaccagctcctgttcccgcccgtccatgctttcgagtttgccgtcatgctgttcaaaaagtttgtccaccgcctgccacatcatctgttcgaagcggtcggcttgggtatccgtatcggtcatcgtgttcttgccttttaaaaatgccgtctgaacatttcttcagacggcatttgggggttaagccaacatttcccgccagcgtttcacttggaagcggacttgttccggcgcggtaccgcccaagtggttgcgggcgtttaagctgccttcgggtgtcagcacgccgtaaacgtcgtcggcaatcaaatcgctgaaaccttgtaagacttcgagcggcagttcgctcaaatcgacgcccgcttggtcggcgtggcgcacggcttgggcgacgacttcgtgggcatcgcggaaaggcatgccttttttgaccagataatccgccaagtcggtggcggtagcgaagccctgcatcacggcggcgcgcatattgtcgggtttgacggttacgccgcgcatcatatcggcgtaaatccgcaacgtgtcgataagcgtgtcggcggtgtcgaacaagggttctttgtcttcctgattgtctttgttgtacgccaagggttgggatttcatcagggtaatcagaccgataaggtgtccgatgacgcggccggatttgccgcgcacgagttcgggcacgtcggggtttttcttctgcggcatgatggacgaacctgtgcagaaacggtcggcgatgtcgataaagccgaaacgcgggctcatccacaaaatcaattcttcagacaggcggctcaggtgaaccataaccagcgaggcggcggctgtgaactcaatggcgaaatcgcggtcggatacggcatcgagcgagttctggcagatttgttcaaagcccaatagctcggcggtgatttcgcgctgaatcgggtaggtcgtcccggcaagggcggctgcgccgagcggcatacggttgacgcggcagcggcagtccgccatccgttcgttatcgcgtccgagcatttcgacgtaggcgagcatatggtgtccgaagctgacgggctgggcgacttgcaggtgggtaaagcctggcatgacggtttcggcgttttgttccgccaaatccagcaatgccgtctgaaggctttgaatcaggctttgtataacggtaatctggtcgcgcagccacaggcggatgtcggtggcgacttggtcgttgcggctgcggccggtgtgcaggcgtttgcccgcgtcgccgattttgtcggtcaggcggcgttcgatgttcatatggacatcttccaaatcggacgaccattcgattttgccgctgcggatttcttcgaggatttccgccataccccggcggatgtccgccaaatcgccttcgtccaacacgccggtttctttcagcatttgcgcgtgtgccagcgagccttggatgtcccattcggcaagccgtcggtcgaaaccgatggaggcggtgtattgtttgacgagttcggaaacgggttcgttgaaacgtccggaccaggttttgtcgtgcataaggattccttgatggggttattcggtgcggtatttttccaaaagccggcggaagggttcgccggtttcgggatgtttcagaccgtaggcgacggtggcttcgaggtagcccagtttgctgccgcagtcgtagcgcgtaccttcaaaggggtgcgccaggacaaattcgtgatcgagcagcttggcgatgccgtctgtaagctggatttcgttgcccgcgccgcgcggaagattggttaagaggtcgaaaatgcgcggggtgaggatgtagcgtccaacaacggcaaggttggagggcgcgtcttcgggcttgggtttttcgacaatgccggtaatgcgttggaactgtttgagctgttcggtttcgacgatgccgtatgagccggtttgcgatgcttcaacggtttctacgcccaaaatgctgttgccgctgcgcccgtacacttcgaccatttgtttgagcgcgcctttgggggcatcaatcaggtcgtcggcaaggataacggcaaagggttcgtctccgatggcggcgcgggcgcacaagacggcgtgtcccaagcccagtgcttccgcctgacggatgtagaggcaggtaatgttcggcggcaggatgttgcggacgtgttccaacaatttgtctttatggcgcatttccaactcggtttcgagttcgtatgccttgtcgaaatggtcttcgatgctgcgtttgttgcgtccggtaacaaacaccatttccgtgcagccggcttccacggcttcttctacggcgtattggatcagcggcttgtcgacgatgggcagcatttctttcgggctggccttggtggcgggcaggaagcgggttcccatccctgcgacggggaaaacggctttccgtatgggtttcattctttttcctttgtattgttttgatgtttaaagggcgagtttgcgtaagagttcggcaagtgcctgcgcgcggtggctttcgcggtttttgacctccgtatccaattcggcggcggttttgccgtgttcgggcagataaaaatacgggtcgtaaccgaaaccgttttgcccgagcggcgtgtcgttccactgcccgtgccatacgccctcggcgataatcgggcgcgggtcgtctttatggcggacaaaaaccaatacgcagacatagcagcagcttttgtctgccttgccgacaagttcggcggcaagtttcaggttgttggcggtatcggatttgggattgtcgcccgcgtaacgtgcggaatggatgcccggcgcgccgtttaaggcggcggcacagatgccgctgtcgtcggcgagtgcgggcagcccgctgtatttggcggcatggcgtgcttttgccagcgcgttttcgacaaaggtgggatagggttcggggcattcgggtatgccgaatgcggattgcggcaatacggtgatgctgtaaggtttgaataagttgccgaactcttcgagcttgccggcattgccgcttgccaaaacgattttttccggtttttcagacatagcggttttcctttgtggcggattgggcggcgcgtagggatttgtgccgcaggtagagggcgaggctgccgatttgtccgaacagtgcgccgaatgcgaaaagaaaggaggcgacggcgaaggctttgctgccgacggtcagcagataagcacccaagaggacgagcagcataaatgccagtgtgaagagggcaacagacaacagatagatttttcggcggttcatggcgttcggtcggaaacggtatgttcggattatagccgattgggacggtattccctagagcttggaaaaatgccgtctgaaacggcgttcagacggcatggcgggcgttatgcctgtttgttccaacgttcgatggattctttgatgacttttttcgcttcttccgcatcgccccacgattcgactttggtcgtacctgcttttttcaggtctttgtaatggttgaagtggaactcgatttgtttgatgagctgttgcggcaaatcggacaaagttttgtaggcgttgccgttgttgcggtcgtcggcaggaacgcagacgattttgtcgtccacttcgccgtcgtcaacgaatttcatcacgccgataacgcgcgcttccaagaatacgccggttgccaaaggttgttcggtaacgagcagcacgtccaattcgtcgccgtcttcgtccaaagtttggggaatgaagccgtagttggtcggtttggcgaagatggcgggttcgacgcggtcgagttggaatgcggccagtttgcggttccattcgattttgtggttgctgccggcggggatttcgttgacaacgttgatgatgccgccgtccacgtcgccgggggtcaggatttggttgaagtctgccatttggtttcctttgtttgggaaagtgtgaagtttgaaagtatagcacaaacgtccggctgaaaatgcgcccgatgcctctgaaagggtgtacgggcgcgtgttaccgtttgcccaaaaacctgcccagttccaaaatcgcgcgcctgttggacggggaaaatactttttccgctgcttcttccatatcgaaccaaccgtaggagacgtgttcttcgggttgcagggcgatgggcgtatcacgcgggatttcggcagagaagaggtgttcgcggttttcaaacacgccttttggatagcggtgccgccagtggtggtagatttcgtaaaccgtgctgtcgtgccagtcttgaagctgcccgtccgccagcaggatgccggtttcttcccaaacttcgcgccttgccgtttgggcgacggtttcgcccggttcgaggctgccggttaccgactgccaaaatccttccggatgcgtgcgttcgatgagcaggatgccgccgtccccgctataaaggacgaccagtgcggaaacggggtatttgagcggttttgccatcggcatctttcggcgggctgcggtaatgaaggggcggattatagcaaacgccgcacgttatggcgtttatccttttccgtatccttttttctgcacggatgggacgcgccggtgtttgccggtaaattttccgttgtgtcaaaaagataagggcggttgtgattttaatgcttgccaaagcgtcgggcggaaactataatccgaaacttatcgagtcggagtgtggcgcagtctggtagcgcacttgcatggggtgcaaggggtcgaaggttcgaatcctttcactccgaccaaaaattccgaaagccgctttcaaaagcggcttttttgccgtccgtatgattatgatgtagagtacgcggcgacagacattcaaatgccgtctgaaaaccgttcagatggcatctctttatcttagtttcattccgtaccatcttaaggaacatcaaattgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggccatatcggattgggaaaaatacaaagccatcagttgggcaacctgatgattcaacaggcggccattaaaggaaatatcggctacattgtccgcttttccgatcacgggcacgaagtccattcccccttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatrgggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataaaaatggcaatttggaattatcggtactaccttatcccatcagctgctatcagaaataaatttaatgcaaataaagatatcatacttgatgagtatcgatctaatggttttcagaattttaatgagaataaaagttttgaaaattactttatcgataatgatgttatattattatcaataataaatgaagcaaaaaaacagcttaaattgaaagaatcttgggataaagacgcaatcatgttttgtgataattttggtaatagtcttaccgtttggccagatgatatagagtgcgaacttgatttaagatttgattatactaaatttattcagaaaaccattgattgggcaataaaatataattgtctacttgtaatagaaaaaacaggaaatgtagtttcccctaatataaataatctgatgtatgaaataaaagcatatttggaaagcaagccgtggcccatatgaaacctaaactcaacaagtaggatgtgtgcggaacgcacgtatgcggttctcaaggtttgagctaagaggccgtctgaaaacagaaaaactgtttcagacgacctttcttttaaccagttgccacagcaaccggacaaaagcagcctacctccacatccatataggcaatacaggggagatattttgtaaattctacgaatattttacctgctaaacagggtaggatatggtatgaagcgaacattggcttaataaacactatgtcaagatcgaatcaggctggtactagattgttgtattccaattatggattgctatatataacaactgatcattatatctctgcaacacggtttgtagcttggaaataggagtataacttatgcaattagagattatcggtagtaaaatttatacggaacaagattttcataatcaaatttcaaaaatattttctatacaagattattatgggaacaatcttgatgctttatgggatttattaagcacaaatgtagaacgaccgattactttggtatggaaagatgctatgttctcaaaaaatcaattagaaaatatatttattgaaatcgtaaatgttctagaaagagttaagaaacaagatgaggattatggattcgaagaaaaatttaattatattttagagtaagtaaaccctaattacattacgtacacaggcttaaaactccccagagccaattaagcaagccgtaacccatataaaacttaaactcaacaagtagcatgtgtgcggaacgtacgcatgcggttcttaaagtttgagctaagaggccgtctaaaaacagaaaaaccgtttcagacggtctttgtttaacgccaccgatccagcgggttacaaagcgcagtcaatgccgctgcgccttatgcctccgaagcaataggcagaacatttggacacggtgaaaacaaaaacgaaaccgcccaagccgtcggacatttccttttaggagcagctattgcccgcgtcaacggtggtaattttgctgccggcggctcggcagcagttgcagctgaaaaggcggcggaacatcttgcccaacagtataacgacggtaaaaccgcaatcgatccgcaaacaggcgagttcaatgccaacctgctgccggaacatatcaaagaggaaatcaaatcaaagagcggggtgattgcatcgctgacgggcgcggccgtgggcggcacgccggtagatgcgcaaaccggaggtgcggtcggacagaatgcggtggaaaacaacctctatctgacatcggaagccttaaagaaggacaagcagacagctcgtaaaatttattccgtcataaaagagcaagtcaagcatgaatgcagttccacaggaagaattaccgaatgtcgtcaaaatataggacgcattatcgaatttacccaagacaaacgctttgacagtaggtttaaggacttaaaaaaagaatccttatattacctaaataaacatcctgatttagtagcctcttatttgaaggctgaatacgaaaagctggatagggaagacaaaagtatcctgcaccgctacatctcacccggggctgaaatcgtttcgggcagtttgggggttgttctttcaggagtagccggaggcggatcttgtgccgagactttcggcttaggctgtgccgccgctttggttggtgtaacgtcttcctacgatcatgtcattactgggacgaaaaacttcggaaaaaaagccagcgagcaacgaccgacgattgcggttcaggccttgaagcagttggggctgtcggagcaggctgcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatagtaatatttatgaaaaattaggagattaatgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttaccacaatgaatttgatgaagaagatggttatccagtattaagctgttcgctgcatacttttaaaactgctttaattgcttggaatgcttttttgcaattgcctaaaagtattcattcggtggtggagactgtgattgaggaataagcataattagcttaatgaatagaatcagcgatatagattggactgcaaatccacgcttatacgctgtgccatgattaagatgttagaacttgtattgaatacaagttctcataaacgaatggcagtaagcatttgatttagataaaatccttgaattagaataatcaggtctaagagctcgacaggacaaatgaggctggcaaccaaggatttggcggaagccattaggaaaggacaggttcgcaaatcaagctttaacacagaacaattaagggcaattgaaaaaggagaatctaaaataccggattacacttggcatcatcatcaagatacaggaaggatgcaattgattcgtgaaggcttgcatcatgataccggccatattggttgggaagcaatgaacaaaggaaggtaactatgtggaaaatcataaaagaggatagtgatgatttagaatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaagccatttccgccgctcagacggcattttcgccccttttgtttacaaacccttaaaatccctttacactcaaaatccgttcaacatcaaacaaaccccgctatgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataaaccgtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccgttgaccagtggatgcaggaaaaccccaatgccgccgaaaccgtcgaagccctggtcaacgtcctgccgtttgccaaagtcaaaaacctgacaaaggcggcaaaaccggggaaggctgcggttagtggggatttctcagactcctacaagcataacactgcttcaagattatctcagtctgtagatggagaaatgtttcaaacccgcaatgttgattttaaagcaaaatctattgggactaaaattcatgatggagctcaagggaaacatatttcaggacatagaaactacattgaaggtaagagtactttaaatcaaaacattaatcctcaagaattgttgaacggaatacattcaggtgcttatccagttatttctaaaggagcaagaggaaatcctgttgttgattttgggtatcctataggcagcgatgggaaatcaggattaagtaccaattttggtacgattcattcaggtaaaaatggagttcacattgttccggctaaccctaaaaccattaaaaaggtgcaatagttatgaatatattaccaagctggctgcgagtcggtatgaatatagcaatgctgggcatgatacactcagatatcaggttaattaccgtagattacgaggaaggaagaaggtttttaaaaatcaaaaattatttatcaagagaagccatcacagaagaccatgaagatatggaatatttgattacagagttatggtctatgtgtggagaatattttgatgaagctgactttgaatgtatttattctaatcattcttctatggagttaaaccaaataaatggtgcagtattcaggagaaaggaattaatttcgcaagcgtaggttaaaaaaaccaacaatcacaatgtcttctgaaaccgtgtttaattttcagacggcatttccttcatttgaaataggatattgagaactgagttcttcaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggcgcaaaacagacggttcaaaacattaccttcaaacagcagccgctcaaagcctacaatctgaccgtcgccgattggcatacctacttcgtcaagggcagtcaggcggaaacggaaggggtttgggttcataatgattgtccgtatgataaaggcaaccaacgatataaagacgcttcttatcatggcaaaaatgataattctgtgaaaagtagagcaccaacaaacggacaagcagctcttgataattccgttcaagttaaatcaacttctcctcgaagagttggggttgataaagccaataatgaaatcgttgtattaaacaaaactcaaacttttaataacggttctgcggaatatcacgggcatgtcagaagttggcaagatttgcataccgatcagaaaaatgctttaaaaaaagcaggattggattagttaattcaaaaggaaaaattaaaaaatgactgataaaagtaaaacagaaaagttgatttcttctgatgataaacaaagtgttatagatggcattcttgatatggtatttaattccaaagcatatgaagtaccgtggatttctgagaaattgatggaattatcgaaaaataaagacttggatattgccggattatcgctaacctgtttcggacatctcgccaggctacattcaaatatcggtgattacgataaagttattcctttactacattcaaagcaagatgatccagagcttcaaggtagggctgaagatgcgttagaagatatttctttatttttatctgaaaatcattaggaaccgtaggtcgggttgaaaacccaacaatcaaaatgccgtctgaaaccgtgtttaattttcagacggcatttctttcatttgaaataggatattgagaactgagttcttcaaaaatcctacacttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaaaaccggggagataaaagccgatggcaggaaagtaaatgtgaggatagacagtacggaggcagacctgctttatccggcagggcaataagaaaacaaaaattagatatggaaaacgattgtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttatttgaaaataaagaaaaaaatgattgggatagaaatcctgctataaattattttttcgagataatagatgatagttatatggactggttgaaagaagaaagttttgatttttttgaaaagaaatattataaggcttatattttcttttttagcgattctgtaatagaagttatcagctcgacagaacctgtattttattcaaaataacaaattatcaaacaaagctctgattaaaaacccaacaatcaaaataccgtctgaaacgatattcggctttcagacggtatttttgacacaaagcaggtaaccaaaggagtgtttgacggaaaaggagaagctaaaataccggatgtatcggttgggaagcaatggataaaggtaaataattatgtggaaaattagtaaagaaaattgtgaagatttaggatttgcaatagtctgtatgttctatgatgctattaatctttctgaatttaaattatggttggatatagttgtcagagatattcctattgatacaattccattgtatatttttgatttgattgattttgataagagtataggggaaatttatgatgtaattggagtcgttaattatggttacatttcaaatgatcaaaaaaatgcattaacgggcattgccttcttaagggggatagatgtctatgatccgcctatttcaaaagaaaaagcattaaaagccttagagaaatatcctgaaatttatcagaggtttcagcatttctttccttttgtagagcttccgcttttttaaaagacaatatgccgtctgaaaagttttcagacggcattttttatttcttccagtaggcgggggtgaagaggatgaagacggtgaagatttccagcctgcccaagagcatggcggtaacgcagatccatttctgcatcacgtccaaaccggcgtaattgccggcgggcccgacttcgcccaggccggggccggcgttggtgatgcaggcgatgacggcggtgaaggcggtggtaaattccataccgctcgccatcagcaggaagctgaagaggacgacggtcataaagtagatgaagatgaaggacataacggtcagcgcgaggcggtcgggtatggccttgccgctgattttgacggtgcggacggctttggggtgcagcagcaccatcatttcgcgcaggctgaatttgaacaggacgagggcgcgtatggttttgatgccgccgccggtcgagccggagttggcgaggatgttggcgaggaaaaacatccacagggaaatcaggagcggccattgtgcgaagtcggtgttggccagcccgtttgccagtccgatggagacgaagttgaaggcggtgtagcgcagggattcggtaaaaccggcgtaatagccggtgtgccacaggtacagggcggcggcaaggatgctgccggagagcagcagcagcatcgtccggcattcttcgtctttccaataggttttgaggctgcggctgttgagggcggcgaaatggttggcaaaattgatgccgccgacaatggtgaaaacgatgatgaccgcttcgatgaggggggagttgtaataagctatgctggcatcgtgggtggaaaacccgcccagcgagagggtagccatcgcgtgacagacggcatcgaaccagcccatcccggcaaaatgcaggcaggctgccgcgaggatggtgatcagggtgtagccgaaccaaagttttttcgccacttgggaaatgcgcggcgacattttgctttctttgtcaatgccggggatttcggctttgaataactgcgtgccgcctacgccgagcataggcaggatggcgacggcaaggacgatgatgcccatcccgcccagccagttgagcatatgccgccaaaagttgacggagggggcgagcccgtcgacgtgggggatgacggtcgcgccggtggtggtcagtcccgacatcgattcaaaaaatgcgtcggtaaagcccatattcgggaaatacaggtacatcggcatcgcagccatagcggcaaacgccagccacaacatcaggacgagggtaaagccgtcgcgcgggcgcagttcgcgcctgaaccggagggtggcgagccggacgatgcacgagccggaaagggtaacggtcgcggtggtggcgaaggcggtgtacgcgccgtccgaaaaggcgtaggagagggcggcgggtatcagcaggataaaggaaaacagcatacccagtcgggagaggacgtgggcgatgggcaggattttgtgcatagtggggcggtccgttattttgcgaagcttttccagtctatgccgccggcggcttggacttgggtaatttcttccgtttcgaggttgacggcggtcagctgtccgccccacagcgcgccggtgtccagcgagatgacgttgtcggcattcgtgtagcccagcgaggaccagtgtccgaagatgatgtgcgtcgaggttttgccggtcgggggctttgaaccacgggcgcaggtaaggcggcatttttttcactgtggatttgtagtcgaaatccagttcgtttttaaaggtcagggcgcgcatccgcgtgaaggcgttgacgatgaagcgcaggcgggcatagcctttcaaaccttcgtcccacgcggccggtttgttgccgtacattttggagaagaatttgacgtattttttgccgcgcagttcggcttcggcttctctagcgagcgattcggctttggttatgcgccattgcggcaggatgccggcgtgtaccatcacgcggctgccctcgcgtatcaacagcggttgcgcacgcagccagtcgagcattttttttccgtcggggtgtttgagtatgggttcgattgtgtcgctgcgtttgggcgcaccttcgccgcagccgacagcgagcaggtgcaggtcgtggttgccgaggacgatttgcacgctgttttcgtgccggatgcagaattgcagcgtttcgagggatttcgggccgcggttgacgatgtcgcccgtcagccagagggtgtccgtgccgtggttgaaaccgattttgccgagcagcgcggtcagttcgtcgaaacagccttgtatgtcgccgattgcgtaatgtgccattgcagatgttgtgaagtgggaaagtgttgcggttcggacggcatggttttgaaatatcatgcagtccgaacgtggaattatgcgttcaaaacgaggacggcttcggcttcgacctgcacgcctttgggcagcgaggcaacgccgacggcggcgcgggcggggaagggctcggcgataaattccgccatgacttcgttgaagacggcaaaattgcccaagtcggtcaggtaggcgttgagtttgacgatgtcggccagcgtgccgcctgccgcttcggcgacggcttgcaggttttggaacacttggcgcgcttcggcgcggaaatcgccgttgccgacgacggtcatcgtggcgggatcgagggggatttgaccgctcatgtaaacggtgtcgcctgctcggacggcttggctgtacgcgccgatggcggcgggggctttgtcggtgtggatgatggttttggacatttcggattcctcaaaaaatagggcggcagaagccgcagcattcgggattatcgtacaaaaccgccggcttgtgtagttgcggtggcagaaaacaaaaccgccgaaggctcggcggtttgcagaataaggcgcatatcagaatttgacgcgcacaccggcggacagttcgccggaacggacgtttttgacagtgttgactttgccgatgtagttgtagcggtagccggcatccaaatcgacattcggggtaacggcatagcttacgcccgtcaatacgccgaggccgatggaggtttggctgaagctgtcgctgccgcccaagtcgacggaggcgcggttgaggctcaagcgcgcgccgagatacggtttgacgggcgattgggtgtcgaagtcgtaaatggcggacgcgccgatgctgtaaagtttgaaatcggtggatggggctttatagtttttgtagcgcgtgtaatcgacggcgaagcggaggtcgttgatgcggtagcctgcggagatgcgcgggctgaagcctttggcagaacctaaagagcttgaggcttttgcgtgtgcggcatcggcttggacgtaaaagccggatgcgccttccgccagtgcggcggccgggagagcgagggcaatcagtgtggcaagtgcttttttcatattttggttcctttatggtcagttagaaaaattgttaagaatccgttaaagaatcctgctgtattatacttaaattttctttttgcatcgtaatattttcaatacttcaagatacgtagcggtatccggctgctttgccgacggcaaagccgttaacccgcgcgttgcctttaaatggtggcggcggcatcacgcggcggatgggtgaaacttgcaaacggtttggaaaaaacagcggtatctgtcggattgttgcaggtgcaggcatacggttttgtgtgcgtctgtgccttaagcgtcggacatttccggcggcggctgtgccgtctgaaacgcccggcgggggatgcggctgcgttttccatcgataagcatattttccggacgcgttcggggcgggttttcccgggcggccgccgatttgtttgcgcttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaaacactgcagcaaatcgtttaaaaacaagcgtcctttttcggtcgggcggaatacggcagggtcggtttccagcaggcctttttgccttgccgtttcgatttgcgccatgattttggcactcggtacgcccgtgcgctcctgcaacatcgcggcgggtacgccgtcggtcaggcgcagggcgttcatcatgaattcgaacggcaaatcttcggcagcgacggttttgcgttcgacggcttcactcggttggctttgcattaaggcgaggtagtcgttggggtggcggcggcggacggtgcgctcgatgcggtcgggataggaaattttgccgtgcgcgcccgcgcctatgcctaaataatcgccgaactgccagtagttcaaattgtggcggcactgcatggctggtttcgcaaaagccgatgtttcgtagtggacaaaacccgcgccttccagcgcgccgtgtaccgcgtcttcgatgtcgagggcggcttcgtcttgcggcaaacctttcggcggcgtatgaccgaacggcgtgttcggttccatcgtcaggtgatacgcgctgatgtgggttgcgcccgtagcgatagcggtttgtacgtcgtccaatgccgtctgaacggtttggttcggcagggcatacatcaagtcgatattgactttatcaaataatttcaaggcggtatcgatagcggttaaggcttccttaccgttgtggacgcgccccagccttgagagcatatcgtcgttgaaactctgtacgccgatagaaagccgcgtaatacccgcgtctttaaatccttgaaacttctcgatttcaaatgtccccggattggcttccaaggtaatttccgcttccggctgcaagcgcaacagcgaacgcacgccgcttaacaaacggtcaatcgattccgcctgaaacaggctgggcgtaccgccgccgaaaaagatcgtttccaccggcctgccccaaatattgggcaattcaagctgcaaatcggtcagcagcgcgtcgatataggcggcttcgggcaatccgtttttcaggctgtgggaattgaagtcgcaatacgggcattttttgatgcaccacgggatgtggatgtaaagcgacaggggcggcagggcggtgagtcgggtgcggtttggaaaggaaatggtgtgcatggtgtggttcggaaaagtgggcaatgccgtctgaaggcggttcagacggcatgggttcagccgagcagggtaagcagttcggcttcgctgaggacggaaacgcccaaggcattggctttttccagcttgctgcccgcggcttctccggcgacgacgtaatcggtttttttggacacgctgccggaaactttgccgcctgcggcttcgattagggattgggcttggtcgcgtttgagggtgggcagggtgccggttaacacgaaggttttgcccgccacggctttattgatgccgtctgaaccttgcgccgcctcgtcttcagacggcatttgcgcgaagaaggttttcaggttttcgagcagggcggcgttttgtggttcgctgcgccacgcctgccagtcggtggggagggctttgtcggtttgcagcccttctatgtttttgccggcgagttcccataaggcttgggctttgttttcgctgattttgaaaccgggcaggcgggcgatccagcgttgcggttcggcgtggcgggcgggcgggatggtaacggcttgggtttgcggggcaacgcctgcggcgagcagttcgtctatcatcgcctgctgttcggcttgggcgaagaagtgggcaatggaacgcgccactaccgtaccgatgtcgggcaggcaggcgaggacgggttcgggggcgcggcggacgcgttccaatgtgccgaatgcctgtgccagcgttttggcggtgcgttcgccgacgtggcggatgccgagcgcgaacaggaagcgggcgagttcgggcgttttgctggcttctatgcctgcgaggatgttttccgcccacttgactggttgttttttatgtttgcccgacgcgccgaccgaactgccttcagacggcatttgatccgattcggcaacggttttgtccgctgtttccttcattttttgcaaggtcgggatgtcgaggcggtagagatcggcgaagtggcggacgaggtcttgcgcgacaagctgttcgatttgtttttcacccaagccgtcgatgtccatcgctttgcgcgaggcgaagtggattaagccttgcgcgcgttgtgcctgacaaagcataccgccgctgcatcgggcgacggcttcgccttcttcgcgttcgatttcgctgcggcagatggggcagtgggtcggcaggcggtagggcttgtggagcggaacggattgggtttgattggcggacggtgtttcggcaaacaaatcgtcctgccgatgcccgatgccgtctgaaacggcaacggcggtttcccgcatcgggcggcgttcaaaaatcacgcgcacaacttcgggaatcacgtctccggcacggcgtacgacgacggtatcgccgacgcgaacgtctttgcgcgatacttcgtcctgattgtgcagggtggcgttggtaacagttacgccaccgacgaatacgggctgtaatcgggcaaccggcgttaccgcacccgtcctgccgatttgcacgtcaatcgcttcgacaatggtcagggcttcttcggcagggaatttgtgggcaaccgcccaacgcggcgcgcgggagatgaagccgagttcgtgctgttgcgccaagctgttgactttgacgaccatgccgtcgatttcgtagggcagttcggggcgtttttgctgcatgtgttcgtaaaacgccaatacttcgtcgatatttttgaaacagccgaaattgccattgggcagactgaagccgagtgcttggaaataggcgagttcctggatgtgttcttccgcgacgaaaccatcttgctggcgggcgacggagtaggggaaaaagtgcagtttgcgttgcgcggtgatgcgcgaatcgagttggcgtaggctgccggcggcggcgttgcgcggattggcaaagggtttttgcccgttttcggcttgtcttttattgagggcgacaaaatcggctttgagcatcagcacttcgccgcgtacctcgatgagttcgggcgtattttcgccgtgcagccgcaaggggatgttggatacggttttgatgttttgggtaacgtcttcgcccgtcgtgccgtcgccgcgcgttgccgcctgcaccaatacgccgtcgcggtagagcaggctgatggcgaggccgtcgaatttgggttcgataacgtattcgggattgccgccgtccaagccgtcgcgcacgcgttggtcgaaggcgtacatttcggcatggtcgaacacgccgttttcatcttgcggggaaaaagcgttggtcagcgacagcatcggcacttcgtggcgtacttcggcaaatcccgccaaaggctcgccgccgacgcgctgggtcgggctgtcgggcagtttgagctcgggatggtttaactccaacgcttcgagttcgcggaacaatttgtcgtattcggcatcgggtacgctgggcgcgtcgagggtgtagtattcgtaggcgtagcggttgaggaggtcggtgaggcggcagatgtgttgtgcggcaaattgttttatatcactatcagacggtttaagaagattggtaaagttagtgttatgttttgagtttggattcatgagagaaggttttcagacgacctttgtctgatacgggatgaaacgggcaaaggtcgtctgaaaaatgataggttgaaaacagctgaattttacccgaaaaaaagcggatatgccgtaacgacatatccgctttgattgcattcgattttaggagaacaggcgcaatgcggttttgccgcccggttcgataccgactttgagcatctcggactgacgcgccaatacataagtgcgcacgtctttgagccattgggtcgaaacttcttccattttgtcgttgaccagattcaggttcaactggccggacaggcgtaccgccaaatccataaacaaatcgtcgaaggttttttcgcctgccggagagtgcgggatgtcgagcagcatactgaagcctttgtaggactggttgtccaaaagggcgttggtaaacggctcgttgttgagcgagcagatggagaacatggtcgagcccgacgtgtcggtatagtggaacgcgccgtcgtcttccaaaacgaaacccacgcccgttacggcggaacgcagttctacgccgctgatgctggtcggggaaaccaaatggatggcgatggtctggtcgacgcgcgcgcagaatgcgtccagtgcggaagccacttcgataaaggcggcaaggtcggtgtgcagcgtctgaccgcccatgctttgtgcgaatgcgtccacctggcggttgaatgcggagagttcttcctgcgaggcaagtccgttgcggctgactgcctgaatacccacgataaatgcctgatagcggatgcccgggatgggttcggcaatctggaaatggtcgtccatggtgcagccgacaatctggtagcggcagcggttggaaaggcgcggcagtgcgtgcagttctttggcttcggtcagcgcgatataggagatgaagtcgaagcgcacgtcaaaccagggtaattcgacttttgacagttctttgagcgtaatcagcggttttgcaggtgtttgcggaacgggtgcaggttttgccggcgcgtcggcaggtttcggtgcggaatgtccggtttggggttcggaaacggtgtgggcggagttgccgataatgccgctttcttccaaggcggtttcgatttcggttttgaacggggaggcttttgcctgtttctgcttggcgatgtagacggcatcctgttcttgcaggttgcgcatggcggggtcttggggttttgccgtttttttgaccgccggttggggtttcggcatcatgactgacccgccggacggtttgccgtcgcggacatggctggttttgctgttgagcagggcatctttgtcggagtgtccgaactggtcgcgcacttttttgcggtattggttttcctgatacatgttgtaggcgacaacggcgaggacgacagctagaaacagtacgatgtaaatcatggcaatcacttgttaaatttcgggatgcaggatacgcaaagtgcgggtactgcggttaaatcgggcttgcactgcggttaaatcgggcttgcgtttccggcagtctgacggaacggccgattataacgtttgaattataacgaaaattgcagggtctgacagcagtgtgtcgaaataagcggaaattttccgaaatgccgtctgaaatctgtggttttcagacggcatttctgtccacgagaaaccctttctcccgtatccgccgccagtcgaaaaaatggccggggtcggttttgcggccgggcgcgatgtcttggtgccccgttaccgccgtgacggggtagtggcggcagattgcgtccaacaaggcttcgagcgaacggtattgcgcttcggcaaacggttcgaaatcgcagccttccagttcgatgccgattgaaaatgcgttgcatttttccctgccgccgaatgaagatacgccggcatggtatgccatattgtcgcaggaaacgaactgtaccgtttctccgtcgcgtttgattaagaaatggctggatacgcgcaaagtgtgtatcaggctgaagaacggatgtccgtcggggtcgagccggttggcaaacagcttttccaccgcatccgtgccgtattcgaacggcggcagcgaaatgttgtgcaacacgatcagggaaaccgtttcccccgtttccctcgggctgaaattgggcgacggggtatggcgtatgctttgaagccagccgttttgccagtgtgcttcggcgtgattgtccatgatgttcttcctgtccggcgggcaatttgggttatactgtcgcccgaattttaagacgtattccgaatgctgggaatcctaccatgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataaaccatgccgtctgaaaagtttgtgttttcggacggcatacccttaccggaactgcaagcatgaaaccgcaattcatcactttggacggcatagacggtgccggcaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaaccctgatgatgttcgccgcgcgtatgcagcacatcgaggaagtcatcctgcccgcgctttcagacggcatacacgtcgtgtctgaccgttttaccgacgcgaccttcgcctatcagggcggcgggcgggggatgccgtctgaagacattgaaattttggaacattgggtgcagggcggtttgaagccggatttgaccctgctgctggatgtgccgctcgaagtgtcgatggcgcgtatcgggcagacgcgcgagaaagaccgtttcgagcaggagcaggcggatttctttatgcgtgtgcgcggcgtttatctcgaccgagccgccgcctgtcccgaacggtacgccgttatcgacagtaaccgcaacttggatgaagtcagaaacagcatagaaaaagtgttggacggacatttcggctgctgatgcggcaaatattgaaacaagcgcatccgcccgcgccgaaaatcaaacggcagtgccgcaggtgaaaatggcggtatgcgccaaactttcggcatgatagaattacgctcggttacaaggcaggatgcgtcggcaatattaacgaaccgcccgtaacatgatgacccgaaagcgtttcggacagtccgattcaaatctttttctcgcaacaggattgacacatggaaaactcattgaaagaagccgccctcaagttccacgaattccccgtgccgggcaaaatttccgttaccccgaccaaatctctggcgaccgacaaagatttggcgttggcgtactctccgggcgtagccgctccttgtatggaaatccatgccgatccgcaaaatgcctacaaatacaccgccaaaggcaacttggtcgctgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgatgaaaaagacccgcaaaaactcgtggacatcatcgccgctttagagccgaccttcggcggcatcaacctcgaagacatcaaagcacccgagtgtttctacatcgaacgcgaattacgcaaacgctgcaaaatccccgtattccacgacgaccagcacggcacggccatcattaccgccgccgccgtattgaacgccctgcgttttaccggccgtaaaatcgaagaagcgactttggtgtgttccggcgcaggtgcggccgcgattgcctgcttgaaccaattgctggatttgggcttgaaacgcgaaaacgtgaccgtttgcgactccaaaggcgtgatttaccaaacccgcgaagacaaagaccgtatggacgagtccaaacagttctacgccattgaagacaacggccagcgcgtgcttgccgatgccgtcaaaggcaaagacatcttcttgggcctctccggcgcgaacctgctgacgcctgaaatactgaacaccatgaacgaaaaacccatcgtgttcgctatggccaacccgaatccggaaatcctgccgccgctggcgaaagaaacccgtccggacgtggttatcggtaccggccgctccgacttcccgaaccaagtgaacaatgtattgtgcttcccgttcatcttccgcggtgcgttggatgtcggcgcgacgaccatcaacgaagaaatgaaacgcgcctgcgtgtatgctttggcggatttggcgatggaagaagtaaccgaagaagtggttgccgcttacggtaagaaatttgaattcggcgcggaatacctgattccgactccgttcgattcccgcctgctgccgcgcgttgctacggctgccgccaaagcagcgatggaaagcggtgtggcaacccgtccgattgcagatttggaagcttacgctgccaagctgagcgaatggaagctgtaagccgtttgcggtttaaaatgccgtctgaactgttttcaggcggcattttgctgtcagattgatatagtggattaacaaaaatcaggacaaagcgacgaagccgcagacagtacaaatagtacggaaccgattcacttggtgtttcagcaccttagagaatcgttctctttgagctaaggcgaggcaacgccgtactggtttttgttaatccactataaatgaaagatactgaaaaatgaaagagatgaaacctgtccgttatcatattggcgatatgcccgagacttcaaaacaaaccgcctcccgtcatgacgacagggcagtgggtgttgacgatgattgttttcatgattcctttggtcaatttttgtttgggtgttcggcagaggcaacccgaaccgcgccaatttctgtaaagcgcagttgcttatttacctgattggttcgcttatcggtttggtcttcgcgttgtttataggtgggtctgtatcaggtacgcatgattaatgccccgggctgattttgcttcgaggatttgtatcgaatatgccgaattgtttcaaatttcataccgttatcgaacggcattggcaaaaaccttatccggttttgtcttttctgcttaagccgctctccgggctgtttgccaaaattgcggcaaaacggcggacggattttttatcgggaaaacggcaaagcgaaaagctgcccgtgcctgtggtcgtggtcggcaatattcacgcgggtgggacggggaaaacgccgattgttgccgcgctggtgtcgggtttgcaggaaaagggcgtcaaggtcggcatcatcagccggggctacgggcgcaagagcaaggcggttcatgtattgaatgctgagagccgagcggaagatgcgggcgatgagcctttgctgctgttccgcaaaaccggtgcgccgacggcggtgggcagcagccgtgcagaggcaggcagggcgttgctggcggcgcatcccgacatcggactgattgtggcggacgacggtttgcagcattacgccctgcggcgagatgtggaaatcgcggtgtttccggcggcggatacggggcgcacggatttggatttactgcccaacggcagtttgcgcgaacctttgttgcggctggattcggtggatgcggtcgtcgtcagcggcggcaaggcggatgcgctgtttaggccgtctgaaaatatgtttcacagccgtatcgaagcgggacggatttaccgtttgaacaatccgtccgaaatactggacacaggccgtctgaaaaatcaaaccgtcgtcgccgtggcaggtattgccaagccggcgcggttttttgattcgttgcggaatatgggcattaccgtgaagcgaaccgtcgcgctgcccgaccacgccgacatttcggcggcagatttgcccgatgcggacgcggtcattattacggagaaagatgcggtcaaattttcagacggcatttgcaccgataatgtttgggtgttgcccgtttgtgcgataatcgaacctgatttggcggcgtttgtgttggagcggttggaagatgtaccgaaggccgtctgaaagcacggtttgggcggagtgattacggatttgaataagaacgcctcgcgccatcattcccgcgcaggcgggaatctaagtctcgaattttcaggaatgcctaggaggctccagaaatcccaaatctccggatttccacttggacaggaatgagaaaaccggtcgtattttttatctgcattaatcattcattaaaggattgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataaatgatagccgtctgaaatattgaagagggcatccgattgattgaaccatcaaacccgaaagcaaccctatggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcgcgagcgttgagcgaagaggaactcaaagcatgaccgaattcgtcgtattgattccggcgcggctggattcgtcgcgcctgcccggaaaagccttggcggacatccacggcaaaccgatggtcgtgcgcgttgccgaacaggcggcaaaaagtaaagccgcgcgcgtcgtcgttgccaccgaccatcccgatattcagacggcctgtcaggcgcacggtatcgaagtcgtcatgacttcaaaccggcacgaaagcggcacgacgcgccttgccgaagcctctgtcgcgctgaagctgccgccgcatttgattgttgtgaacgtacagggtgacgagccgctgattgcccccgaactcatcgaccgcaccgccgaagtactcgtcgaaaacaacgtccaaatggcgaccgccgcccacgaattgcacgatttcgacgaattgatgaatcccaacgccgtcaaagtcgtcctcgacaaaaaccgcaacgccatctacttcagccgcgccccgattccctatccgcgtgatgcgatacgtgccggaaaacgcgaaatgccgtctgaaaccgccgtcctgcgacatatcggcatctacgcttaccgcgccggcttcctgcaacgctatgccgaaatgagcgtttcgccgctggaaaccatcgaatcgctggaacagctgcgcgtcctgtggcacggttatcccattgccgtcgaaaccgccaaagaagcccccgccgccggtgtggatacgcaagaggacttggacagggttcgcgccgtatttcagaccgtataaaacaggttcaaagggaaaagatatgcagcaacatattgaaaagtggcaacacttgagccgggaagaacagaaaatccttgctgaagtatggggtctcgtgcaaaacgacgatcaggaggttcactatgaaatgctcaaattgaacgcacccgatgaagccagcggcgaattttggttcagaatggcagaaacactcagcaccctgccgcccaaccgttccctcggccttagaatgaacggcggcaggctggcgaccgccgtatccatcctttccgtcatgattgaagacaatcccgacataccgcagctttgggcgcaaaaaattaccgcgctcaattatagtggattaaatttaaaccagtacggcgttgcctcgccttgtcgtactatctgtactgtctgcggcttcgtcgccttgtcctgatttttgttaatccactatatttggcacacgggcacaaagcccgtgccgacggtttggcacaacagcccgacaaagcggcagaagccaacgaggaggaatacctgaccaaagccctgtcgcaaaacctgctgtcaacattggatgtcgcgcttgcacgttttcctgaagacgcgtggtttcaggaaatcaaacaggatgcacaaaagcattttgcttgaggatgtggcagtcaggaatatttccattcaggaagaaaagaagtgcctgattgggtataatcagggtaaatcttattttatttcaaaagattaatatttgctttctgtttttccttgacggtatcggaaaagttgattatagttacagcttccttaggagtaatggctgagaggctgaaggcacttccctgctaaggaagcatgtggggtcaacctgcatcgagggttcgaatccctcttactccgccagataaaaaatagacgctgtgttttacagcgtctattttttatgcaattttatagcgggttggtgcaaaaccagtatggtattgccctgtcttgattctgaattttgttatagtggatgaacaaaaaccagtacggcgttgcctcgccttagctcaaagagaacgattctctaaggtgctggagcaccaagtgaatcggctccgtactatttgtactgtctgcggcttcgtcgccttgtcctgatttttgttaatccactataatccgagatgcttgccgtttatttccgcctcgttcaaacggcggctctgatttgcgcggtttctgtttgccgtattcgcctatccgtaccgcaaatgttatactgggaaaaatttactgattgtgttttacggcatatttgccgataggatggaagagacaaatgagcagaatccggcaggcttttgccgctttggatggcggaaaggcattgattgcctatattacggtgggcgaccccgatattcggacaactttggcattgatgcacggcatggttgcaaacggtgcggatattttggagttgggtgtgccgttttccgatccgatggcggatgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaaccctgtacataagatgggttatcgggagtttgctcaggaagccgcaaaggcgggtgtggacggcgtgttgacggtggattcccctgtcgaaaccatcgatccgctctatcgcgagctgaaggataacggggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcatcagtatatcgatattcccatcggtgtcggtttcggcatcagcaatgcggaaagtgcacgcaaaatcggccgggttgccgacgcagttattgtcggcagccggattgtgaaagaaatcgaaaacaatacaggcaacgaggctgccgccgtcggtgctttggtaaaagagttgaaggatgccgtgcgctgacggcggttcctcatcctgaatattttaggagttgtccatgagctggttagataaaatcctgccacccaaaatcaagaatcgcggaaaagacggttcttccaatgttcccgagggtctatggcacaaatgcccgtcttgttcggcaaccgtttattctaccgagttgcagcagaacaatcaggtttgtccgaaatgcaaccaccacaatccgttgtcggcacgacaacgcctgaacctgcttttggatgaggatggcagggaggaagttgccggaaatgtcaaaccgacagatcctttgaagtttaaagacggcaaaaaatatccggatcgtttgagtgcggcacgcaagctgaccggggaagatgatgctttggtggtgatgaaaggcaagatgaacggcctgcccgtcgtcgttgctgcgtttgagttccgctttatcggcggttcgatgggttcggttgtgggcgaacgattcgtacaaggtatccgtcgggcggttgccgacaattgtccgttcgtctgtgtggcggcttccggcggcgcgcgtatgcaggagggtgtaaactcgctgatgcagatgacgaaaaccagtgccgcgctgcatttgctgacggaaaaacgcctgccatttatatcggtgttgaccgatccgactatgggcggcgtatccgccagcttcgcatttttgggcgatgtcgtgcttgccgaaccgaacgcgctgatcggttttgccggtccgcgcgtgattgagcagacggtgcgcgaaacgctgccggaaggcttccaacgcgccgagttcctgctggaaaaaggcgcaatcgaccagattgtcgaccgccgcgatatgaagcggcgcatcagtgatttgattacgctgttgtgccgtcaggacaaagtttccgccgcctgatggctgatgaatcgagtaccgtctgaaaccgatgtttcagacggtatttttgtgtctggttatttgttgtgcggctttatcgatggggcatagcgtccggcacgttctttcaggcgttgtaccaaacctttcgtgtcggcgggtacaccgccctcgcagaatgcctgatacaggacggtgcgcagtgcgtcgttgcggcttaatgtaccgcctatcggtttccattcggcgtttcggggctgtatccagcggcggttgaccgtgtcgccgtagccgaacactttataggaggaaggtttgccgttgccgaacctgatggagaagcgggcgcagaatatgcctttggcagtcaggttgtcgtagcctttgtcggagcggatattgagaatgtagcggatgctgccgtcgggcgcgggcataatttgcaggctgtcgagcaggattttcggctgtttgccgtaattttcatccacataaatgtcgaaccagccgtccgagtgcgtatcgggcagcggcggcagtttggcggtatgttctttaaattcgcgggcggcggcctcttcgggcgtttcgcggtagcgggtgttgatcggcgtgtctttttggctgaagccggcagcgagggacgtgccggcggcgagtgcgagcagcaggagggcggtgcggcgcataagtttctccaaattgaaaacggcgttattttatgggttggcaaagggggctgcaagcaactggggtataatctccccccgattcccattttttaaacggtacaaacgatgaacagcgaaactttagacgtaaccggattgaaatgtcccctgccgattttgcgggcgaaaaaggctttggcgcaaatgcagcagggcgacgtgttgaccgttctggcaaccgacggcggcgcaccgggggattttgaggctttttgccgccaaaccggtcatgtgctgttggatgcttccgaacaggacggcgtgttcacgctggtcgtccaacacaaataaatgccgtctgaaatgcggatgtcccgcccgacggcgttgtttttgaatatcgtatgtgccgcgtgccgtttcaaaaacaaaccgtccggcgtgcagtgtcggcatttcgggcgtatcgccgccgatttgttccggaatggctgttaaccgccttgccgtcggcaaagaagcaaaacccaagcacaatcaaaatctaaaggctgtgtttgaagattccgttgatgcaacccaatcagtcggacaaaatgcctttcatccaatggaaccggtttccgaccggacggaataaccggctttcccccggcaaacggatggaatcgaccgggtattcaaacgcagccaaaacctaaaaaggaacaaccatgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattgatgggctggaaacaaaatgccgtctgaagggagggctttcagacggcatttgtgttgctgactgattgatacgtcaacggcgtttgagtttgttacgtttcggttatttccgataaattcccacaattttcaaatttcgccattcccacgaaggcaggaatccagaaattcgatgcgaccagagtttatcaaaaacggcagcaactcaaaaaaccggattcccgcctgcgcgggaatgacgagattgaagtttcagaatttatttgaaatacccaaaattcaaaaaaccaaattcccacctgcgtgggaatgacgaaacaaagaaagcagaaataaggacatagaactttctttaaatttgtgatgcatcaacggcgtttgggctcgtcggggcggatttgggcggcgagtttgtcgaggatgccgttgacgaatttgtgcccgtccgtgccgccgaaggttttggtaacttcgatggcttcgttgataatgacggggtagggcgtttcgggcatggcggacagctcgtggcaggcggtcagcaaaacggcgcgttcgatggggttgaggtctttttcgtccctgtcaagtagcgggcggatttgtcggatatactctgccgcattggtttgcgtgccgaagaaaagtttgttgaacaattcttcgtctgccttggcaaagtcggacatttcgcggatgtttttagcaatttcgggcgcggcggtgcggttgataagggattggtaaacggcttgtacggcaagctcgcgggaacggcggcgggctgttttcatgatttttccttgaaacggttgggcggcacggtatgccgtctgaaacggaaagggtgtattggtgtacgccctgtttgttattcttcgtcttcaaactgttcttcgagcagcaggttgacgaggttggcgcattcgacggcgactttggcggcatccgaggctttttcttcaatccgttcgattgcctgcgcgtcgttttcggtggttaggacggcattggcaatcgggatattgtagtcgagtgcgacgcggctgacgcctgctccggattcgttggaaaccagctcgaaatggtaggtttcgccacggatgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggaggtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaatgaaagacgatgttttgaaacagcaggcacacgcggcgatacagaagaaactgggctacgcgttccgcgatatttcgcttttgcggcaggctttgacgcacaggagccatcatgcgaagcacaacgagcggttcgagtttgtcggtgattcgattttgaattatacggtggcgcggatgctgtttgacgcgtttccgaagttgaccgagggcgagttgtcgcggttgcgggcaagtctggtcaatgagggcgtgctggcggaaatggcggcggaaatgaatgtcggcgacggcctgtacttgggggcgggcgagttgaagagcggcggcttcagacggccttcgatactggcagacgcgatggaggcgatgtttgctgccgtcagcttcgatgccgatttcaacacggcggaaaaggtggtgcgccatttgtttgccgatcgcgtccggcgcgccgattttcaaaatcaggcaaaagacggcaaaactgctttgcaggaggcgttgcaggcgcgccgtttcgccttgccgaaataccgtatcgaagagcaaatcggttatgccaacgacagtatgtttgtcatttcctgcgatttgggcgaactgggtttcgtgtgccgtgccaaagggacgagccgcaaggcggcggagcaggaagcggcgaaagaggctttgaaatggctggaagagaagctgccgctgaagaggaaaaagaaatgaggcggcgcgtgaatatgccgtctgaacatatggatacgaaagcaaatatggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtagtttttcttgctgaactttacgcaaatgccgtccgaacaggtttcagacggcattttgtttcaatcgggaatatctttgttaaaaacgggttgatattatctgtgcatattatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaatccactataaagaccgtcgggcatctgcagccgtcattcccgcgcaggcgggaatctagtccgttcggtttcggtttttttggctagtgccgcaacattaaatttctagattcccactttcgtgggaatgacgcgattagagtttcaaaatttattctaaatagctgaaactcaacgcattggattcccgcctgcgcgggaatgacgaatttcaggttgctgtttttggttttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaactcaacgcactggattcccgcctgcgcgggaatgacgaatttcaggtttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaattcaatgaaccggattcccgcctgcgcgggaatgacgaagtggaagttacccgaaacttaaaacaagcgaaaccgaacgagccggattcccgcttgcgcgggaatgacgggattaagttttcaaaattcatcagaaattactgatttaatagcataaattttttagattatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataagtcattccggcggcaatttttgttgctttaacgggataggcggttggcggttgcgataaaggcggcgactttggcggcatcttttttgcctttagacgcttccacaccgccggatacatcgaccgattccgctccggtgatgcggacggcttcgccgacgttttcaggggtcagcccgccggcaagcacccacggtttgcccgaatattccgccagcagcgtccagtcgaagcggtttccggtgccgccgtattccgaaggatggtaggcatcgaacagcagtgcctgagcgtcggggaagcgcgtggcggcgtttcggatgtctgatgccgtctgaacacgaatggctttgatataggggcggtggaactggcggcagaatgcgtcgtcttcgtcgccgtggaattggatgatgtgtatcggcacttcggcaaggatgcggcggatgttttgcgcgctttcgttgacgaaaagggcgacaacgctgacaaacggcggcagtgcggcggtgatttttttggcgcgggcaatatcgacggcccggctgctgccttggaaaaagaccagcccgacggcatccgcacctgccgctgcggcggcagctgcgtcttccggtgtggtgatgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatgaaacgggaaatgtgatgccgatatgggaaatgccgtctgaaaacccggcgttcggatttcagacggcatcgcggtttgggaagccttattcttcgtcgcccgcatcgctgatgctgatgctgtgttccatcctgctcgggtggattttcagaccgccgcagccggatttctcggcagacaggcggtcgaggtaggcatcatcgatgtcgccggtctgataaatgccgttgaaacaggacgaatcgaaggattcgattttcggattgagtgctttgacgacggcttccaaatcgcccaagtcttgaaatacgatgccgtccgcgccgatttcggcggcgatttccgccgcgctgcgcccgttggcaatcaactcttcgcgcgtgggcatatcaatgccgtacacattgggatagcgcacttcgggcgcggcggaggcgatatagactttgcgcgcgcccgccgcgcgtaccatttcgacgatttcgcggctggtcgtcccgcgcacgatggagtcgtccaccagcaacacgcttttgcctgcaaattcggtttccatcgggctgagtttttggcgcacggattttttgcgcgtcgcctgtccgggcataataaaggtgcggccgatatagcggtttttaatcaaaccctcgcggtagggtttgtcgagatggacggcaagctccatcgcgctggggcggctggtgtcgggaatgggcatcacgacatcgatgccgtccacgggcagctcgcgtttgattttttccgccagcgacacgcccatatccaagcgcgattggtaaacggatacgccgtcaatcacagagtcggggcgggcaaaataaacatattcaaaaaggcaggggctgagtttggcacggtcgctgcattggcgggcaatcattgtgccgtcaaagccgacaaataccgcttcgcccggccggatgtcgcgttccaaatcgtaggtaagcgcgttgaaggcgacggattcggaggcgacggcataggattttctgccttcgctgtcggtttgcgaacccaataccagcgggcggatgccgtaagggtcgcggaaggcgagcataccgtagcccgcaatcatggcaatcacaccgtatgcgccgcgcaccaggcggtggacttgggcaacggcgttgaaaatattgtcggcattgagccggtgcgggtcggcgtttttagagacttcgcggcgtaattcgtgcgcgaatacgttgagcaagacttcggaatcggagctggtgttgacgtggcgcaggtgtttgttacacacgttttcatacagttcggcagtgttggtgaggttgccgttgtgcgccaaaacgatgccgaacggcgagctgacgtagaaaggctgcgcctccgcgctgctgcctgcgttgcccgcagtaggataacggacgtgggcgatgccggcgttgccggtcaaatcgcgcatattgcgtgtgcggaacacttcgcgcaccatgcctttgcctttgtgcatatggaaggtaccgccttccgccgttgcaatgcccgccgcatcctgccccctgtgctgcaacatctgcaagccgtcgtacagaagctggttcacgggttcatgactgaccaaacctaatacgccgcacatatcgtcttctccgattcgaggtttaagggtaaaacggaattataaagtaaacggtggttttttgcctgaattgttgacaatatttgagcgaaggacagataggtgggtttatggagaataagatttatagtggattaaatttaaatcaggacaaggcgacgaagccgcagacagtacaaatagtacggcaaggcgaggcaacgccgtactggtttaaatttaatccactataatctgtgatatggctgaggaaaggaaaaaacatttcagacggcataaaagaggatgccgtctgaaatatccgtatggcaatcaatcgtcttccggagtttccgccgtgccgccgctatggttcaacacggcttcggaaagcgatacgaaaaacggcagtgtgtaagattgccgccattcttcggtatcgggcaggtcggtttttgaagcaagcatgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttgatttgacgcggtaaactttgccgttgtcggtcataatttcggtgatggtcgaatcgatacccgccgccttcattttgcgctggaggcttaaggcgcgttctttttcggcataacctgcctgaatggcggcttttttaccggatttttccttctcggcggttttggtcttgtccgctttgtcggttttttgtgccgtttcgtgttttttgccgtccgaacggtctttttcggctgtttttttgctttcagccttgtcggcttttttcgcttcttttaccgcgctgtcggattttgccgtatccggtttggttttttcggcggcagttttcggtttgtcggcaactttttcggcggttttggtttctttggctttgggcttggctttggcagtgcgttccgctttttgcggttttgtttcggcagtgcgtttcggtttttcaaccgctaccgtatccgtactgtcggcagttgccggcactttttcggcagcgcgttgttttgcctgcttcggtgcggttttggcggtttctgcctgttgcagtttctcggatgcttccaaacctttgatgttgctgtcttcgaggcgctcgttaatcagcaccagcggcgcgcctacgttttcaggctcgctgatttcgctgtcggcggcagaaggcttgtcttcgcctgccaagtcctgcggtttgtcggcggcggatttcaaggcaggggtttgtgccgcacctgccgctttgttttctacgccgcttgtttcgccggcagtctgttcggcagggccggaactgagggcggctgccagcaggatgcaggaggcggcaaccaggcaacttgccgttacgaggcggcggcggttgcgccgtttgagttgttcgtaaccgctcaggacttcgttttgtttgttttcggacatagaagtttccttttaaagtaccgacatgacatcggcaacggtatgaaatgagccgaaaacgacgattctgtcgttctcgcccgcttttgaggctgccgcccggtatgcttcgcggacggcggcgaatgtttgtatgttttcgatgctgtgttcgtgcagtttgttttgcaggctctcgagcgtcatgccgcgcggtacatccaacggtgcgatataccactcgtcaaactggtctttaacggtttccaacacgccgtctatgtctttgtcggacaacatgctgaacacggcggtgcgtttttgcgcaaacgccaaattaatcaggctgcggcgcagggcgcgggcggcgtggggattgtgtccgacatccaaaacggtcagcggccggccgggcaggacttggaagcgtccgggattttcaaccagcaacaaaccgcgcttgatggcaccgatgtccaccggcaatttgtcgttcaagcattccaatacggtcagcgcgcaggcggcattggaaagctggtatgtgccgcgcaatgcggggaagggcagggcattgcggttgcgcgcggggtcgtctgaatgttgcggccggaagcggtagttccattggatgttttccatcgcgtgaaactcgaaatcgcgctgcaccatcagcagtttcgcgcctatggcttcggcgtgtgaaagcaacgatttgggcgcggggttttgaccgcagatggcgggtttgccgctacggaacacgcctgctttttcaaagccgacctgctcgaccgtatcgcccaaaaatgcctgatggtccaaatccacgctggtaaccaccgcgcaatcgccgtcaaacgcgttgaccgcgtccaagcggccgcccaagccgacttccaatatcatcacgtcaacctgttcgcgcatgaagatgtcgacagccgccaaggcattgaattcaaaataagtcagtgatatttcgccgcgcgcggcttcgatgcgctcgaaagaggcaataatcgtatcgtccgaaacgggttcggcgttgatggcgatgcgttcgttgtaacgcaataaatgcgggctggtcagcgtaccgattttgtagcccgcctgtttgtaaatctgtgtcaggtaggcacagaccgaacctttgccgttggttcccgcgacaacgacgacggggcattgcggctcgagcttcatgcgttttttcacttcgctcgtgcgctccaaacccatgtcgatcaaaccgccgctgtgggcggtttccaaatgcgagagccagtcttgtagtgttttcatgagtgtttcgttttcaaatgccgtctgaaatcagtctgatgtatcggtttcggcggtttttttcggctgccgccaaagtacccaaactttcagcttgcggtaggattctttgtccgtcatgtcgggcatgatgcattggcggacggttttgccgccggtgtcccattgtaagaataaggcataaggcgtaaccatactgctgcccgacagtgccgccgcctttgccgttttgtctttgccggatacgatttccgcctgtccgtcgcggtctatggtaatggcggttatggcatggcggtgtttcagattcgttatcctgagcgagtatgcgtaacttgccaccaaagccgccaaaccgaaccacatcatccggccgtaaaaccaagtcaggcagacggcaagggaggcggcgtgaagcgatacagtcaggatgttcaggatgcgggacggcctcaatgccgtctgaaaggcgcgcacagccttacatcatgttgtcgaacacgggggtaatgttcaattccgcttcttccatgttcaacactatatcgtggatttcgatgtcgaaaaattcccaaaacgccttcagccccatatcttgcggccatttatccttatcgatgtcccaacctgccagctccgcctcgaaaatctgccggtagcgttcgtcgaagtaggaaacgacggcttccggttcgtcgaactgcggaacgaggaagacggaacagttggcacgaagctgctctatggtcaggtcgggcatattttcgtcggtgcttttgagccattccaaaaagcgcgcggtcggcttgaggacgacggcggtgcggtcaacaaaatacatggttttctttctcaatcatcttgcggtgtcgggatatgctgtctgaacgttcggttttcagacggtatagcatcagtgggtcatgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgcccttaaccttcatcggtgcgagggtaatgttttccaacacggtcaggtgcgggtagaggttgaagccttggaatacgaagccgacttcttcgcggattttgttcaaatcggttttggggtcggcaacgttgacaccgtccacccaaatctcgccgctttcgatgctttcaagctggttgacagtgcggatgagtgtggatttgccgctgcccgaaggcccgcagacgacgaccacttcgccttttttgatttccaagtttacgccgttgatgacgtgcaggtctttgaaatgtttgtgtacgtttttgaatttgatcatgtcttttctttcagacggcatttgccgttgcaggttgtcgttacgggagctccatatgatgaagcgtgtagcgtctgccgtcaaaaaaacggtcgttcggattggtcaggcaggctgcaagcggcagtatcaggggtaaaagcaggtatttcgtcatcggcttactcccttttcagacgaccttgcccgccagataattgctcaacgccacgtatttctctggcgcgatatgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaaccgaaaacggcagggcgtgataatgctgtttgaaggcttgccgtgtttggcggtttggtgcaaaaaccggctgtctgccgttttgcctgttggaggattgaacgtgtctgaaaatctgcttgaaatcgaaacccatcccttcgatcccgtgttgccgccgaaggctgctgtcatgatgatggggacgtttccgcccaaggaagacaaacgcgcgatgcagtttcattatccgaatttccaaaacgatatgtggcgcgtttatgggctggtgttttttaatgatgcggcgcatttccaaaggttgtctgaaaaagcgtttgatgccgagaaaatcaaggcgtttttgcacgaacgggggattgcgtcctgtccgaccgttttgaaggcggtacgtcagcacggcaatgcgtccgacaagtttttaaaggtagttgaaaccgtcgatttggcggcggtgttggcaaaaatacccgagtgccgccatatttgtacgacaggcggcaaggcgacggaaatcctgctcgatattcagggcggcggtatcaaaatgccgaaaacgggcgaaaccgtgccgtttccgtttgccggacgggatttgacgctgacgcgcctgccttcgacttcgcgcgcctatcctttgagtttggcgaaaaaagcggcggcgtatcgggcgttttttgaaatggcgggcttgtgtgaaaaacagttataattgccgacaatttcccgttcagacggcatgtttgcaaaaacggaaatgccgtctgaaaatttgaagcacaaggaagaatccgatgaagaactaccacgcgcccgacgagaagggctttttcggcgaacacggcgggctttatgtctccgaaaccctgattcccgccttgcaagagctggcggatgcctataaggcagcgaaaaacgatcctgaattttgggaagcgttccgccatgatttgaaacattatgtcggcaggcccagccccgtttaccacgccgcgcggttgtccgaacatctgggcggcgcgcaaatctggttgaagcgcgaagacttgaaccacaccggcgcgcacaaagtcaacaacaccatcggtcaggcactgttggcaaaacgcatgggtaaaaaacgcgtcatcgccgaaaccggcgcgggtcagcacggcgtggcgagtgccaccgttgccgcacgcttcggtatgacttgcgacgtgtatatgggcgcggacgacatccaacgccaaatgcccaacgtgttccgtatgaaattattgggtgcgaacgtggtcggtgtagaaagcggcagccgcacgctgaaagacgcgatgaacgaagccatgcgcgaatgggtcgcccgcgtggacgacacgttctacatcatcggtaccgccgccggccccgcgccgtatcccgaaatggtgcgcgatttccaatgcgtgattggcaacgaagctaaagcgcagatgcaggaagccatcggcagacagcccgacgttgccgttgcctgcgtgggcggcggatcgaacgccatcggtttgttccacccgtatatcggcgaagaaaacgtgcgcctcgtcggcgtggaggctggcggtttgggcgtgaacacccccgatcacgccgcgccgattacttcgggcgcaccgattggcgtattgcacggtttccgcagctatctgatgcaggacgaaaacggtcaggttttgggtacgcactctgtttccgcaggcttggattaccccggcatcggcccggaacacagccatctgcacgacatcaagcgcgtcgaatacactgttgccaaagacgacgaagcactcgaagcctttgacttgctctgccgcttcgagggcatcatccccgcgctcgaatccagccacgccgttgcttgggcggtgaaaaatgcgccgaaaatgggtaaagaccaagtgattttggtcaacctctcaggtcgtggcgacaaagacatcaataccgtcgcgaagctcaaagggattaaactgtaacctcgtccgtctgatatagtggattaacaaaaaccagtacggcgttgcctcgccttgccgtactatctgtactgtctgcggcttcgtcgccttgtcctgatttttgttaatccactataaaaatgccgtctgaagcctgagttcagacggcattttattttgctatgaatttagtattttagaaacgaatctgtattttaatttgtccggatttttgtttttccaattgttttccttttgtaatactgccatttacgtttaatgtaacattacggtacagtaacgcggcacctgctgaatattgctgttgattatctgctttatagacgaaggaattaccgcccacattcacgccgcctttgccataattggcaaagtaagctgcagataacaagggttttacggtaaggttgccgactttaaaccgataagcaaaatccagtccggccgttagtgttttcactgacatagaacttactttaacactgtcgttacccaacttgtaatctgcagatgacaggcggctgtaacggatccccgcactggggacaatctcgaattgattgattttcagcgtattgcccaaagtaaggccggtttggatgcttgctcggttaaagtttgctttttgctgcgtttgtaaccggcttctcaagctgcctgcaccaatatcgccggccacataccaagcatcatttaaataatacttaccataaaggttggcttgcacaaaagtatttttgccgctcgcctgatcaaaagtatgctgactgtcagagtaagtcaatacgccgcctatctgcatattttcggacaagctgcggtcaatgccgatttgtgtttgcgtgcgtttcgaactaaaccggcgatattgtgcggaagcataatcacgaccataaccggtgttcgacatccaaacactgtttttttcggcatcagcgcgtgatttttgtgcaatgtgccgtgttaatgaagcacctgtatccaacaagatagattgcgtgcttgccattgcgtcagataaagccgagttggtattggtgctgactgcatcggcttgcgcggcggcttgggcttgcagctgagtggcggcttgggctcgcggctgcgcggctcttggttgcaaactcactgtctcaactttttcatgaagttccgtattgtcttgaggctgtttgtctgatgtgtcaaccgattcggatacatcttcatcttccaacgcatccaaggggatttcttcataatcattttcatatttttcatgaagttccgtattgtcttgaggctgtttgtctgatgtgtcaactgattcagatacattttcatcttccaacgcatccaaggggatttcttcatagtcattttcataccagtccggattatgcaaggccctgggtgctgcgtaagctgacgaatcaaatgatggcgagggcggtgccggcagagtagatctgcgtccgcgacgtttcggacgattttgggaagctgccatataatcctgaggtgcggcacggcgttttcggcgttgcggctgggattgggctgcttgacggtgctcttcttcctcagcttttcgtttcgccgattctgccgcttctcgatctgtttcggctttttgttttgccgacaactctgctgcttggcgttccgcttcttgacgacgtgcaagttcggcggtctggcgagcttcttgctggcgttttgctgcttcggctgctgccctttgcttggcaagttcggcggttttgcgttcggtttccgctttttgtttgacggctaactctgcagcttttcgtgcttcttcctgttgacgcgcaagggctttttgttggcgtgccgccaatgcttgggcttcagctgcggctttttggtttgccgacaattctgccgctttgcgttctgcttcctggcgatgtgcaagttcggcagcttggcgttttgcctcttcggcttctgcttttcggcgcgcagccaatgcttgagcttcacgttcggcttctgccctttgttttgccaacaactctgccgctttgcgttcttcctgctgtcggcgcgcaagttctgcttgggcttgggcaatttccacattgttttgctgtaccgaacggtgtccgcggcgtttaggacggtcttgggaagctgccatataatcctgcggtgcggcacggcgtttgcggcgttgcggctgggattgggctgtttgacggcgttcctcttccccgaccctttgttttgccgacaactctgccgcttcgcgttctttttcatgccggcgtgcaagctctgcagcttggcgttttgcctcttcggcttctgcttttcggcgtaccgccaatgcttgagcctcacgttcggcttcgactttttgttttgccgacaactctgccgcttcgcgttctttttcatgtcgacgtgcaagttcggcgctgctgcgttcttgttctgctttttggcgggtcgccagctctcttgcttcgcgttcggcttctgctttttgttttgctaactctgccgatttacgctctgcttctgcttgctgacgcttcacttgctccgcttttgcttgctggcgttttgcttcttcggcttgatttgcctgcgggctaggcggtgcgacgacgatattttgaggcttggcaatttgtgcaccgtccgtttgtgttgccttttgtgcttgagaagccgtgtttgtggcaggagacggggccggtttgactcggcggcggttctcggcataaggattgtacaatcgggtaataccgttttctgttttgattgtataacgcaatgcccctaaatctacatggttattcgccaaggaaacagaaaggcgggagcggtcttgtacggatgatgcatcaaagagattcagcccttcctgattgggttcgcctgttttatcttgaacatggagctgataatgaccggatgcggattccttcacaagcactttatccccaagatttttcgccaggtgcgtcagataatgaaaatgcccgttaccggataaatgattgattttgagcgtgtggtatttatttgcactttgcgcatcggaggcattgttcaaatgaatatggctatccgccaatgacagattgtgtacttggctgtcgccggtcaaatgccatttgctatgttggtttaggctgacacggctgtttccttgcccttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgagttacgcttatttttccgtttaaattagtgccgcctgttaacaagaaacggttttgcgcgcttttgccgttgaaattaaggtttaatgcaccgttatgtccttttccgttttcttcgccaaagaaaccgctaaaaccgctaatacgctgattgtttttgtggttcatcgcgtttttcttggcttcttcttgtgtgctgcccattaaaatccagtcgttattttccgtttgtccgttttcgggcatcggtgcgttcacgctgccgccggattttagggcgtaataacggtagtttttgaaataaagatctttgccttgtggaatcggtttcctagggcggtaatagtaataaccagcatcgtcatcatcattattttgaatataatgaatagagatggttttgggatcggtaatcaaagatttacccgttagcgtgattgtggaggcgtggcctgtgttgtggttgacaatgcgcgcgccttcatccacgttgcggatgtgttcaaaagtcaagtcattgccattggcatccaaacgaccgccacggaaaccgaaatataggttatcgggattaatctgatttgaactatttaataccaatgtaccgcgtccgctgacaatgccgacttgggagaaagcctggacttttttgtcggcatcggcttgttgattcagaataaccgtaccgtcgccgacttttaattgcccttggttaacgcctgtgccgtttatttctaatgtgcctttgccgatttttgccaatctgtcgccattcggatttttgacttgccaaacgacttttttgccgtcggcaacatcaatccccgcacctagccaagtgatgtcattatttatacctttgactgtgtaatcgcctttgaaaaacagaccgcccgcgccttggttgatgttttgatccaataccaaagtgccgttgttttcaaaggtaacattctgtccgttgtttgcatccctttcattgttggcaagccttaccgctgtcgaaccgatatggctgtttgtgcccgtggttttccaatgatgttctccattacctttgatggtgccggcgttatcgcgttgtttgatttcatctgcaaattcttttttatagatattccattcttgccaagagtttttttgatagcctgcccaataatcgtaagcacctaaaaagacccagcgtttttcttgtttatcataagcaaataatggtgaaccgctatcgcctaacacagcatagttagtcaatgcgttttgagataaaacttctttgagtttttctggggaatgatgttttgaattatcaccgaagccaatcaagccttcttgatttagattcgatgtgacattcacgtcttgataaggcgtacctgcaatggcataacgataagctcgtgaaagctctgtcatattgtagcggctgttatattcaaattgcgtacctgctccaactcgcacaaactcagaaaaacggtttttatctttataggtttcaacgccgccgcctgcactggttggtgcaataggtgcgacttctgttacgaatttattaaggcgtgccatgttgtagtcttcaagacgaccttgattaccgtgatgccaatttttatttggttcgtagtcattttgtgcaactgaacgatattcgttttcatcattgctaacatctaagtgcccattgtgatgcccgtaataagagatttcgtctccttttacatgtttgacgctgacggcatactggggatcgatgacggttaatgtacgtctgttgacatctgcaacgctaaaatcaatcatcggtacgttggataatgcgttgccgatgttttgaccttgtttgtttttcactgataaatcggttgcgccgacaaaaaatttgcctttgttttctgcaaagtcacggaatatttgataatcgacatcgtctctgaccaatgccgcttctgagtatggcgtaagggcataggcaagaaagatggataaggatatggcgttaattttaaaacgtttggttttcataaggttttaccgttttaagggtgataatgttttgtattttacgccggtttggtggtgttgactattttttgttgtgtaaatcattcattttggtgttttattgccaatttaaaaaaagaatcccgatgtttttatttccgcttcctttgttctgttattcaagcgaaggcgggaagccgattttcggggttcggttcttccgttaaatttctgcggctttttgtttttggattcccgcttttgcgggaatgacgggattttaggtttctgattttggttttctgtttttgagggaatgacgggatgtaggttttcttaaccctgagtcctagattcccgctttcgtggtaatgacgagatgggggttcgtgggaatgacgcggtgcaggtttccgtacggatggattcgtcattcccgcgcaggcgggaatctagaccttagaacaacagcaatattcaaagattatctgaaagtccgagattctggattcccactttcgtgggaatgacgggattttaggtttctgattttggttttctgtttttgtaggaatgatgaaattttgagttttaggaatttatcgggagcaacagaaaccgctctgccgtcattcccgcgcaggcgggaatctagaccttaaggcagcggcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagaacgtggaatctaaagaaaccgttttacccgataagtttccgcaccgacagacctagattcccactttcgtgggaatgacgggattttaggtttctgattttggttttctgtttttgagggaatgacgggatgtaggttttcttaaccctgagtcctagattcccgctttcgtggtaataacgggatgtgggttcgtgggaatgacgatggaaagtttgccgttgtctcggataatactgaggcttttcgtttgcattcttatagtggtttaacaaaaaccagtacagcgttgcctcgccttgtcgtactgcttgtactgtctgcggcttcgtcgccttgtcctgatttaaatttaaaccactatatcattttcaaatcttgttatgacggtttttcggatttgctttattatccgtttatttttgaaatatctggggtggggagacgtgttccgtcgttggtttttgccgtgttgggttgtcggcgcggcggcttcgtttgcgctgccggtcgtgccgcattggctgttttggctggcggcttttgcggtttttgctgtgtttgcaaggcgttttgcgtttgccggtctgatgctgtgcgtgttggcgggcgcggcttacggcgtattcagaacggaagcggcactgtcttcgcaatggcgggcggaggcggtttcaggtgtgccgttgacggtggaagtggcggatatgccgaggtcggacgggcggcgcgtgcagtttgcggcaaaggctgtggacagcggtggtcggacgtttgatttgctgctgtcggactacaaacggcgcgaatgggcggtcgggagcagatggcggataacggcacgtgtgcaccccgtcgtcggcgaattgaacctgcgcggtttgaaccgtgaggcgtgggcattatccaacgggataggcggcgcggggacggtcggtgcggacagggttttgctgcatggcggaagcggttgggggattgcggtttggcgcagccgcatcagccgtaattggcagcaggcggatgcggacggcgggctttcagacggcatcgggctgatgcgcgcgttgagcgtgggcgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcccggccgcgcgtgtgggttttggcggcggggtgtgcaggcgcgctgttttacgcgctgcttgccggtttttccgtgccgacgcagcgcagcgttttgatgttggcggcgtttgcgtgggcttggcgcaggggaagattgtcggcgtgggcgacgtggtggcaggcgttggcggcagtgctgctgttcgaccctttggcggtcttgggtgtggggacttggctgtctttcggtttggtggcggccctgatatgggcgtgttcggggcgtttgcacgaagggaaacggcaaaccgccgtgcgcgggcagtgggcggcttcggtgttgtcgctggttttgctcggttatctgtttgcttcgctgcctttaatcagccctttggtcaatgcggtggcgattccgtggttttcttgggtattgacgccgctggcgttgctgggttcggtcgtgccgtttgcgcctttgcaacagttgggggcatttttggcggaatatactttgcggtttttggtgtggcttgccgatgtgtcgcccgagtttgccgttgccgccgcacctttgccgctgttggtgttggcggtgtgtgccgctttgctgttgctgctgccgcgcggcttgggtttgcgtccgtgggcggtgttgctgttggcagggtttgtgttttaccgttcacccggcgtgccggaaaatgaggttgcggttacggtttgggatgcggggcagggtttgtcggtgtcggttcagacggcaaatcatcatcttttgtttgacactggaactgcatcggcggcacagacggggattgtgccgagtttgaatgcggcgggtgtccgccgtttggacaagctggttctgtcgcatcacgacagcgaccacgacggcggttttcgggcggtgaggaatattcccgccggcgggatttatgccgggcagccggaattttatgagggggcgcggcattgtgcggaacagcgttggcaatgggacggcgtagatttcgagtttttgaggccgtctgaacgcaaaaacatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaaacatccgaccgaagcggtgcagaaccgtgtccgcgcacacggcattaaactgctgcgtaccgatttgtcgggtgcgctgcaattcggcttgggacgcggcggcgtgaaggctcaacgtttgagagggtataaattctattggcagaaaaaaccgtttgagtgaggtttgaaacataaaatgccgtctgaaacggattcagacggcattttggcgttaacgccggttcgtgctggcaaggcatatcgtttgattttcagtgtgcgtcaaaaacagaaagggcgttgcggttaacggcagggagaaccgtttgaatgaacggaaaggtttgcgccagaaggggaaatgccgtctgaaagggcttcagacggcatccggacatcggtgcggaatcagtgccagtaacgccaccagggcatatcgtcagatcgccacggctgctttaagaacgggcttttcgggaagttggtttccaacacgcggcgcgtatcggcggcaagccggggcttgtccaacttcttgtaggcaagttccaatatggcgagcgattcttcgacatagcgtgtattttgatagctgccgataattttttgggcgcggttggcggcggcgatatatgcgccgcgtttcatgtagtaacgcgctaccgacatttcattgccgcccaaagcatcgaccagtttgaccatgcgtgcggtcgcatcggcggcgtatttgctgttcgggaagcgttggacgagttccgcaaaggcctgatacgcttcgcggttggctttcgggtcgcggtcggaccagtcttgcgaggccagcttgttcaagaaagattgatcttcgttgaacagtaccaaaccgcgcaggtatagcgcgtagtccatattcgggtgttgagggtgaaggcggcggaagcggtcaatggcggccagcgccttatccttctcatcatctttatagtaggcgtatgccgtatccagttgggattgctgggcatggcggctggtagggaagcgcgattccaagatttcgtataatttgacagctcgcgtataattgctgctgttcagctcgtcctgggcttcggcatagagtttttccacactccagtcttgggtaatctgggcatctttatctaccgtaccttgagtggcacaggcactcagtgccaaacctaatgaaaccgttaaaagaatttttttcatgcagaatacttcctttgataatgaatccgattatagcgacgattcagactttgcgtcagcttccgaaactgaaaaccgtatcggtctgaccgttccgctcgagcttgcaggcgggcggttggatgcggtattggcgaaacttctgcccgactactcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccagagcctatggctttggatattgtttacgaagacgataccgtcatcgtcgtcaacaaaccggccggactggtggtgcatccggcggcgggcaactggacggggacgctgctcaacggcctgttggcgcactgtcccgaattgagccaagtaccgcgcgcgggcatcgtacaccgtttggacaaggaaaccagcgggctgatggtggttgccaaaaccctgccggcgcaaaattccctcgtgaggcagcttcaagagcgcacggtcaaacgcatctaccgcgccgtcgccaacggcatcgtccccttcgacggtaaaatcgaaacccaaatcggacgcgatccgcacaaccgcctgaaaatggcagtcgtcaaattcggcggcaaaccagccgttacccacgtcaaagtgttggaacgctatcttacccacagctatatcgaatgctcgctcgaaacgggcaggacgcaccaaatccgcgtccatatgcgcgaggccaaccatccgcttgccgccgacccggtttacggcaacccgcgccatccgtgcggcgacacggtgaaagaagccgttaaaagtttgggtgcgcgtcaggcgttgcacgcctaccgcttgagtttcacccatccggaaagcggcgaaaccgtttcgtttgaagcaccgattccaaacgacatatatcatttgttatccgtcctccgtcttgaagccggtttggattcgtctttgagcaatgaagaagaatggcaggacaaattcggcgcggacgacgacgatgattggaacgaagacgactatgatgtcgaagtggtttatgtaagggagtgaggcggcttgaaaggcggggcgaacgcaggcagccgaatcggagcagccgggcaatcgtccccgccgatttcaaacaaaggccgtctgaagggaccgggcagaaaccgccggttttgtttgccccgttcagacggcattatgataaaaggcgtttagggttttttatgtttaccggctttggccgcccaataagttgccagcagcgagccggagatattgtgccacacgctgaacaatgcgcccggaacggcaacgaccggcgcggcggcaaagtgtgcggcggcaagcgcggcggccaggcccgagttttgcataccgacttcgatggtcagcgttttttgtgcatcataaggcaggccggtccatttggcggcaaagaagccgagcaggtagccgatgccgttgtggagtacgacaaccgcaaaaatcagcaggccgctttccataatcttgcctttgcttgccccaacaaccgcgccgataatcagcacgatggcggcaacggaaaccagcggcagcgcatcggtcagcttttcggttttactgcccaaaaccttatggacaatcaaacccaaaacaatggggagcaaaaccattttgacgatggacatcaacataccggccgcttggatttccagcatttcgccggcaagcatcaggaagatggcgggagtcagcaatggggaaatcagggtggaaacagacgtaacggcaaccgacaaagccacattgccacgcgccagataggtcatcacattggaagccgtaccgcccgggcagcagccgaccaaaatcacgccgaccgcgatttcggcaggcaggttcaacagtttggacagcagccaggcggttgccggcataatggcgaattgtgcgattacgccgatgatgacgactttgggatgtttgaacaaaatatcgaagtcggaaggtttgagcgtcaaacccataccgaacataataatgcccaacagccaaggaatataaggccccgcccatttgaaggtgtcgggcgcgaaaaaagcggcggcggcaaagagcgcggcccagagggaaaatgtttttccgataaagctgctgattttactgaggatattcataaataatgcgttgcgtgtttgtttttaagggaaggcaagcatacacgccttaaccttaatttgcaaaatgaccgtgcctaaacaatgccgtctgaaagtggagattggttttcagacggcatcgcccgagagatgtcggaaatggactttatccccattccttttcggttgaaacccgtctgtttatggcgatagaatctaatcggagggtagtctcgttcgggcaacacgcagtgcggtgcttgatgtgccgtcccctgttgaaacatataaagctcggagaaagtatagtggattaaatttaaaccagtacggcgttgcctcgccttgccgtactatttgtactgtctgcggcttcgtcgccttgtcctgatttaaatttaatccactatatataagggcatcattcctgcaccggcaagaatccgaacccgaacgtttgaaaacaatcccgaatctccgaattcccgcctgtgtgggaatgacgaaaaaacaagcattcatttgccccgaaggcagttaatcaaccctttccgccacacacctattccaatatccaatgaaaaccatcacagaaaccctaaatctcgccccgaaaggcaaaaacttcctgaccgccgattggcccgcgcccgccaatgtgaaaaccctgattaccacgcgcaacggcggcgtgagccaaggtgcgtatcagagtttgaacctcggtacgcacgtcggcgacaatcccgaagccgtgcgccgcaaccgcgaaatcgtgcaacagcaggtcggactgcccgttgcctacctcaatcaaatccacagcaccgtcgtcgtcaatgctgccgaagcgttgggaggcacacccgatgcggacgcttccgtagacgacacgggcaaggttgcctgtgccgtgatgaccgcagactgcctgcccgttctattttgcgacagggcgggtacggcggttgccgccgcacacgcgggctggcgcggtttggcgggcggcgtactgcaaaacaccatagccgcaatgaaggttccgcccgtcgaaatgatggcgtatctcggccccgccatcagtgcggatgcgtttgaagtcggacaggatgtgtttgatgcgttctgcacgcccatgcccgaagccgccaccgcatttgaaggcataggcagcggcaaattccttgccgacctttacgcgctcgcccgcctgattctgaagcgcgaaggcgtgggcggcgtatatggcggcacgcattgtacggttttggaacgggatactttcttttcctaccgccgcgacggagcgacagggcgtatggcgagcctgatttggctggacggcaatgccgtctgaacacgccgctgatataatctaccgactttgtgtttttgagaaaggcaagccatgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatgacgtggcggcacatatcggacgcattgatacggacgcgcctttgaaacccctgtacgtcatccacggcgaggaagaactgttgcgtatcgaggcattggacgcattgagggcggcggcgaagaaacaaggttaccttaatcgggaagtttatacggcagacaatgccttcgattggaacgagctgctgcaaaccgcaggcagtgcgggtctgtttgccgatttgaagctgttggaactgcatatccctaacggcaagcccggcaaaaccggcggcgaggcgttgcaggattttgccgcccgattgccggaagatacggtaacgctggttttgctgcccaaactggagaaaacccagctccagtccaaatggtttgccgcattggcggcaaagggggaagtgtgggaagccaaaccggtcggcgcggcggctttgccccaatggatacgcggacggctggacaaaatcggtttgggtatcgaggcagacgcattggcactgtttgctgagcgcgtggaaggcaatctgttggcggcgcgtcaggaaatcgacaagctcgggctgctgtatccgaaagggcataccgtcaatatcgatgaggcgcaaaccgccgttgccaacgtcgcccgcttcgacgcgttccaactggcaggcgcgtggatgaagggcgatgtcctgcgcgtatgcaggcttttggacggattgcgggaagagggcgaagaaccggtgctgttgctgtgggcggttgccgaagacgtgcggacgctgatccggcttgctgccgccctgaagcaggggcagagcatccaatccgtccgcaacagcctcaggctttggggcgacaagcagacgctcgcaccgcttgcggtcaagcggatttccgtcgtccgcctgcttgacgcgctcaaaacctgcgcccaaatcgaccgaatcatcaaaggtgcggaagacggcgacgcatggacggtattcaaacggcttgtcgtgtcgctggcggaataaagcggtaatccccaaaatccgaaaatactgtaaaataccgttaatcctgaaaagtattcaccaatccgtccgaaaacatttcagacggcacgaccacctcaataaaggaacattaaccctatggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaaccgccgcaaggcatctttgcataaatgccgtctgaagcctgttggcgtttcagacggcatattctgattgaaaagatgatgacactgaaaaccgccccgctcaaacgccgctttgccgccatgctgtacgaaatgctgctggtcggtgcggcaacctgtttggcagcattgattgccggtattgccgccatttttctgaatcccgtttctatcgcggtttctgcattggtaacaagtatcctgataatgggagcatggtggctttatttccgcgccaactggcatggtcaggggcagaccttggcgatgaggacatggaaaatcggcttgtgcgaccttaacggcatacagccgtctttgcacctgctgcgcctgcgctttatttgggcgtgcatatttatcgtatttatccctatgttagcctatgccggattacgccacttcctcggcattccgcccaagggcgcggccggcgcggcattgatttggctgattttaccgtgggggttcgcactgctgaatcccgatcggcagtttctgtatgattttcttgcaggaacaagattggtggcggtcaaaggaaagccttaagcctttataccgcaaaggtttcaacctgaaaaaatgccgtctgaaagggctttcagacggaatttgcttatcggggaaaccgattattcgatattctgcacttgttcccgcatctgctcgattaagactttcagttcgaccgaggcttgggtgcattcggcggcaatggatttgctgcccaaagtgttggcttcgcggtttaattcctgcatcaggaagtccagccgtttgccgctgctgcctttgtgttcggtaacgatacggcgcacttcggcaatgtgggtgcgtagcggctgaactcttcgtcgatgtcggatttttggataaagagggcaaattcctgttgcaggcggtcgttgtcgatgctgccgaccgcttcgacgaggcgggcgcggattttttctttatgtgtttccaacagggtaggaaagagttcgcttaatgcatctatgatttcttccatagcctcaaggcgttgcagcaggtgctcgcctaatttcttaccttcccgcttgcgtgcggcagtaaagtcttttaacgctttttcggtcagttcggtaatgctttttgccaattcttccgtattttccctttggcttgccaatacgccggggaaacgcaggatgtcggcaacgcccagttttgccaaatcgtgatgcttgcggaggtctttgttgatttcggcaagctgtccgaccaagtcgcgattcagttccaaggactgactgccgttttccgcatcttgaatttggattttgcattcgactttgccgcgtgcgatatgggatgaaattttctcgcggataccgctttccaaatagcgcaaatcgtcgggcatcctgatttgaatatctagaaaacggtggttgaccgcacgcaggtcgagattgatgcgtttgctgccgcactctgccgccgcgttggcaaatccggtcatgctgtggatgtggatatttccgctgctcatgtcgttctccgaagcccgttaaaatggaatcaatatatcacatctgtatggcggcaagcgttttcgggtgtgaaaaattgaagattttgcagcggcagattggaatcacgcgcttttgttgctgcaaggaagggaaatgtatagtggattaaccaaaaccagtacggcgttgcctcgccttagctcaaagagaacgattctctaaggtgctgaagcaccaagtgaatcggttccgtacgatttgtactgtctgcggcttcgccgccttgtcctgatttttgttaatccactatatcaattccgccaatctgtcggaaaagcagctgatgcggcagtgtctggtgcatgtctgctttttgatttcggcaattgcaacggcgtggacggataaaatcgtgtacagcacgacgcacaaaccgcattgatgtttaccaaataaaatacccgacaaaacaatttgtcgggtattttattgcgtatatttcaaaccgcttcggcttcttcggtcaggaaaccacgcagtttctgcatggcttttgcttcgatttggcggatgcgttcggcagatacgccgtattcggcggcaagctggtgcagcgtcagcccgccgtcgtcttgaagccagcggctttccacaatacggcggctcctgtcatccagttgcgccaaagcgttttgtaaaccttctgtttgcagggcgtaatgcgcctgtttcgatagttgtcggctcggttcggaatcgtggtcggcaagccagtcgatgggggcgaaactatcctcgtcgtcgctgttgtctgccatgatggcgatgtcgtgtcccgtcattcgctgttccatttccagaacttcggaaagtttgacacccaaatcgtcggcgatgtcttgtgcctctttgggagacagggcgttgaggtttttacgcatgctgcgcaggttgaaaaacagcttgcgttgcggtttggtggtggcaacgcgaaccaaacgccagtttctcaaaataaactcgtggatttcggctttaatccagtgtacggcaaatgaaaacagacgcgcgcctctaccgggctcgtagcgtttgaccgccttcatcagtccgatattgccttcctgaatcaggtctgcctgattcagcccgtagccgtcatagccgcgcgcgatggaaacgacgacgcgcaggtgggacaggatgagttgtttggcggcgttgaggtcgcctttgtgttggcgttcggcaaggcgtgtttcttcctcttgggtcagcatgggaattctgttgacggtgtggatgtattgttcgaggctgccgttgccgctttggatggcgggtaatgcgaaagcgttattcatttgggacatttcctttcggctgaaactgcgtatcggcggtttgctgtgttgggatgcagtatatcactgcttggcttgtattttgtatatttggcaggagatatgcgctaaggtttgaaagacaggaaaaattttgtaaggcaagtttgattgattttgtaaacctgatggctcaattcgattttggaattatattacatacgtggttgtatgtaaatagccgttttgaaaaaagacagcccgtccggacgggctgtgcaggtatcagtgttctttgtttcggaagatgaaaagaatcagtgcggctagggccaatatgcccatcaaccaccatgaactgccggttttcatatagggcgtttcgccgacatagcctttgatgtgtccttccaatacggtttccgtatcgggttgggcttgggcgatgatgttgcctttgggggagatgatggcggttgcgccggtgttggtggcgcggaccatatagcgtccgagttccatagcccgcgcctgcgattgttggaggtgctggtacatggcgttggattttccgtaccacgccatattgctggcattggcaagcagggtggcatcttttgcggcggcaatcagttcgtcgccgaatccgtcttcgtaacagatgttgaaggcgattttttggtttttcatcagcagggcggattgcttgccgccgcctttgcggaagtcggaaaggggcatatccatcattttgtaaagcggcgtggtcaggaaaggcagcggtttgtattcgccgaaggggacgaggtggtttttggcgtagtaggggataccgtcctgattgttttcctgataaccggtcaggttgatgacggcgttttcgtaaccgttgccgtccgaagtgtattggctgatgccgacggcgagcgcgctgccgttgttttgcgcctgttcggcaaatttcgccagtatgttttccggcaggttttggcgcataacggggatggcggtttcgggcaggatgacgatgtcggcggtggttttgccgacttgttcgtaatatttctgtatggtcgggataacttggtcttcacgccatttgagggtttggtcgatgttgccttgaagcagggcgacggtgctgcggctgccgtcggggcgggtgaagtcggtttgtcgggcggtgtagcctgcggcaagcagggcggcaatcaggataatcggaagcaggcgtttgcccgaacgtgcggtgttattactcgccaaaaccagccagacaccgagaaaggcggttgccagtgtaaccatgtggatgccgcccaatggggcaaagccggcgagcgggctgtccggggtgatttgggagtagccgattgcgccccagccgaatccggtcaggaaacgttcgcgggcaaactcggtcagcgtccacaggatgggcagtaccaaaccgatttttatgccccgaggcagggtaaattttttccacagccagaaacacagtgccggataaagggcaaggtaggcggggagtaggaaggtcagcggtacggcatagaggtcgggcaggccggaaacgtcgtgcagggcggtgtgtatccagtagaactgtgtcgtgtatgcggtcaggccgaacaggtaggcggaagagacagcaaaacgcggacgcagttcgatgaggcggacgaaggcaccgaaaatcaagggcatcagccaaaagtggtagtagggtgcgaaggtaaagggggtggcggcggcaaaaaggatgagcaaaggccagtagagggcggggtgctgccagtatttgtccagtttggaaaccatattcatctgtctgttcggaagataccgtctgaacatctttcaaacggcatcggtatttgaaaaaggaatcaatgcctgccgaaacgattcatcagcggcaaggcgggggcgcaggcaatcgaaccggaaagcagcccgacaacgaggttggcgaagtactccgcccagccagcgtcccagtgttgcgcgtgcaggaaatcgtgcagaaggccgaggttgtgggcgaccagtacgccgccgataagaaacatggcaagcgtgccgaccacgctcaaaccgcgcataaagcaaggcataaaggcagtcagcatttgccccaaactgcgcgaaaaggtttgtgggcggcgcatcagcagcatgcctaagtcgtcgagtttgacgatgacggcaacgattccgtacaccaaaacagtcatgccgatgccgattgccgccattacgagcatgcgcgtcatgtcggtgcagaaacttgtgcagcagcttttctacgccttcaaagcacagataaatgccgcctgccgtcaaaagcggcgtaatgagttgcggcaggaaggcggaaagcagcagggccgcaggcaccaaaaccggcttgttggaaaaagaacctttcgccatcgaccaaacaatcggcaactcgcgttctgccgatacgcccgtaacccggttggcattgggtgccaaatcgtcgccgaccacgccggcggttttctttgcggcggctttggtcatcagggcaacatcgtccaaaacggcggtgatgtcgtccggcagggtaaatagtgaggcaaatgccattaaagaatcctgaaatgcggcgcaaagtccgacattatataggagaacgcggatttgggcggtttcaggcggcatgaaacaggaaaatgccgtctgaacgctgtggcggacgtgaagtaaagtttcgtgaaaagaaaataccgtgttacagtctttcgattttaatttcatgaattttaagggagaatcgttagcgtggattggatgggcagtctgttcctgccgggtggcgcactgttgtttctgagcgtggtttcgaccactttgtccgcacgtttgggaatgcctttgctgctggtttctcctgccaacgtgttggacagggcggcggaagccttggcgattgcggcgttcctgatgctggtcgcgcgtccgtcggcagtgttcggcggtttgtggaaattcaattacagcctgcgtgaaaaggcgtatagccgaatagaaatgcagtccgacaccgtgcttcaggcggggatttggcgtggtacatcctgcccgacggcaaggtcgatatagtgaattaacaaaaatcaggacaaggcggcgagccgcagacagtacaaatagtacggaaccgattcacttggtgcttcagcaccttagagaatcgttctctttgagctaaggcgaggcaacgccgtactggtttaaatttagttcactataaaatggcgaaatactttaccgagacgggtattagcgtccgtgagcattttgatttcttcggtgagtttgtcgtttcgccggcagcacgttcgggtgatttggcacttacttacggtttgaggctggaagcgggcgaagagggtttgagccttgccgagcttttcgataagcgttccgatagtcaggagccggtcgagggcggccgtattgacatcggcggctttatgctgaccgcaaaggaggttgacggtggcggcaatatcgggtctatggggctgaaagtgctgcgttagaaaggtttgatttgaatgccgtctgaagccggattgccggtttcagacggcattttgtctgtttagttttttttgctttttgcctgttttacgtctttttcggtaacgcttccgccgccgttgtcaaaggcgttcatgatataagtggcgacggcggcaatgtccgcatcgctgatggcggttgcgggcatgaatccgttgtaggttttgccgttgactttgattgtaccgttgatgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtagtatagtggattaacaaaaatcaggataaggcgacgaagccgcagacagtacaaatagtacggcaaggcgaggcaacgccgtactggtttaaatttaatccactataaggttgcacttgatgttgttgtccagcatagatgccatcatacgctaaagtagcgggaaaatgccgtctgaacacggcgttcagacggcattttagacatgggtcaaacagtttcaacgccagctgccaaggttttcttcggcaagtgcgacgagtgcatctatccagtcggggttgtcgttgaggcaggggatgtagcggtagcttttgccgcctgcttcataaaactgttcccgccccatcagggcgatttcttccatggtttccaaacagtctgccaaaaagcccgggcaaaatacgtccagctcggttaccccctgtttgggcagtttgccgaacaaatcctgcgtgctcggtgtaacccattttgccctgccgaattggctttggaacgatacgacatattggtcttcggtcagttccagtgcttcggcaagcagtttggcggtgtggcggcactcgtcgggataggggtcgccgaggtcgtggtgcttctgcggtacgccgtgaaaactcaacatcagttttttcccgcgcccgtgttccgcccaatatcggaggatgtggtttttcatcgcatcaatgtagccggtatcgtcataaaagcgcgaaacggtgcggacgctcatttggttccgttgcagcagtaattgttcgcacaccttatctactgccgctccgctgctggaagcggcatattgcgggtacatcgggatgaccagcagtctgcccgcgccttgcgccttcagttccgacaatacgtctgccaccgaaggattgccgtaggtcatggcgtggcggacgatgaggtcgggcatacgtttggcaagcgcggcagcttggcgtgctgtgtaaacttctaagggcgaaccttccttaaaccagattttttcataggcgtgcgcgctttttttggggcggagcgtcagtaccagaccatgcagaatgggataccacagccatttgggcagttcgacgacgcgccggtcggtcagaaaggacttcagataaggtcgtaccgcctgcgcggtcggcgcgtcgggcgtgccgaggttcaacagcaaaacggcggtacggttttgttgcgtataggaaagggagggttctggaaagaatggaagcatgatcggtttctgaaaaatagtgcgggtagggtaaagcggcaaaatgccgtctgaagcggcttcagacggcattgcagggaatcagtctgtgccgcgtgcgcggttttcgtggaatcgcgcctgccagtcggcaaatttgccttgttcgacggcttcgcgcatttccgccataatgacttggtagaaatgcagattgtggatggtgttcaactgtgcgcccaagatttcgccggtgcggtgcagatggtgcaggtaggcgcggctgaagttttggcaggcgtagcaggtgcagctttcgtctatcggacgcttgtcgagcttgtgtttggcgtttttgattttcaaatcgccgaaacgggtaaacagccagccgttgcgtgcattgcgggtgggcatcacgcagtcgaacatatcgatgccgtgtgccacgccgtacacgaggtcttccggcgtgcctacgcccatcaggtaatgcggcttgtgttccggcagaatcggaccgacggcgcgcagcatacggtacatttcgggcttgggttcgccgacggacaaaccgccgacggcaaggccgggaaaatcaaactgttccaaaccgcgcagcgattcttcgcgcaaatcctcatacatcgcgccttgcacgatgccgaacagcgcgttcgggtttttcaaatcttcaaaggcttttttgctccgttccgcccagcgcaggctcatttgcagcgattttcgcgcctgttcgcgcgtcgcctcgcccggcgtgcattcgtccaactgcatcgcgatatccgagttcaaaaccgtttggattttcatggaaatttcaggcgataaaaacagcttgtcgccgttaatcgggcttttgaacgtacagccttcttccgtcagcttgcgcatatccgacaaagaaaaaacctgaaaaccgcccgagtcggtcagaatcggtttgtcccagccgataaaaccgtgcaggccgccgaattgcccgataacttccaaacccggacgcagccacaaatgataagtgttgcccaaaataatttgtgccttgatatcgtgcaggttttgcgggttcatcgccttaaccgaaccgtaagtaccgacaggcataaataccggcgtttcaattttgccgtggttcaactccagcgtgccgcgtcgggcgagaccgtcttttttgtgtaaggtaaatttaagcataagattgaatgtcagttgggcgacaggggtcgaaatatattttaaaagacggcattataaatgatttcccacggtttttcagacgacatccccaaatcttgccgcaatgttgcataaagaaacgcacatacctcttgcaaaaattaaaacgacccgataaaatgcaaaaattctttgaaggcacgtagctcagttggttagagcaccaccttgacatggtgggggtcgttggttcgaatccaatcgtgcctaccaaattcccataacggcatttatgccgttattttttaatctttcggagcgtttgatgttgaatattaccttgccggacggctcagtccgccaatacgaatcccccgttaccgtggctcaaattgctgcgtctatcggtgccggtttggcgaaggcgacggtggcaggcagggtaaacggcaaattggtcgatgcgtgcgacccgattgttgaagattctgctgttcaaatcattactccgaaagatcaggaaggcatcgaaatcatccgccattcctgcgcgcatcttgtcgggcatgccgtcaagcaactctatcctaatgcaaaaatggttatcggccccgtcattgaagagggcttttattacgacatcgccacggaaaaaccgtttacaccggaagatgttgccgccattgaagcgcgtatgaaagaattgattgcccaagactatgatgtggtcaaaatcatgactccgcgtgcggaggcgattaaaatttttcaagagcgcggcgaagaatacaaactgcgcctgattgacgatatgcccgaagtggaagcgatggggatgtatcatcaccaggaatatgtcgatatgtgccgcggcccgcacgttccgaatacccgtttcctgaaaaacttcaaactgaccaagttggcgggcgcatactggcgcggcgacagcaataatgaaatgctgcaacgcatatacggtacggcttgggcgacaaaagacgaattaaaagcctatattcaacgtatcgaagaagccgaaaagcgcgaccaccgcaaacttggcaagcaattggatctgttccacctgcaagacgaagcgccgggcatggtgttttggcatcctaaaggctgggctttgtggcaagtgattgaacagcatatgcgtaaagagctgaacgccgccggttataaagaggtcaaaacgcctcaaatcatggataaaaccttttgggaaaaatccggccattgggacaactacaaagataatatgttcgtaaccagttcggaaaaacgcgaatatgcggttaaaccgatgaactgtccgggtcatgttcaaatttttaacaacggtttgcgttcgtatcgagatttgccgatgcgtttggcggaattcggttcttgccaccgcaatgagccgagcggtgcgctgcacggtctgatgcgggttcgcggttttgtgcaggatgatgcgcatattttctgtaccgaagatcaaatcgtcagcgaggctcgtgcgttcaatgaattgttgattcgcatctacaaacagttcggtttccatgatgtatccgtcaagctttctcttcgccctgaaaaacgcgcaggttcagatgacgtgtgggataaggcagagcagggtttgcgcgaggcattgactgcctgcggcgtggaatggggcgaattgccgggcgagggtgcgttttacgggcctaaaatcgaatatcatgtcagagatgccttgggtcgttcttggcaatgcggtacattacaactggatttcgtattgccggagcgtttgaatgccgaatatgtaactgaaaacaacgaccgtgcgcgtcctgttatgttgcatcgcgccattttaggttctttggagcggtttatcggcattctgattgagaaccatgcaggctcattcccgttatggttggctccggttcaattggtaattatgaatattaccgaaaatcaggcagattattgtcgggaagtggctgccaaattgcaggcggcaggattccgcgccgagttggatttgcgtaacgaaaaaatcggttacaaaatccgcgacaacagccaataccgtttcccttatcaaatcgttgtcggcgataaggagaagcaggaaaacaaagtggcggtacgccgcaaagcagaagatttgggttctttggatttggatgatttcattgcgcaattgcagcaagaaatcactgatgccctcgtcaatcattaatttttataggagtattcatcatcgctcaagaacgcgaagcacgaatcaacggcgaaattaccgccaaagaagtgcgtttaatcagtgagtcaggcgaacagcttggtgtcgtttcagttcgtgaagctttggctatggccgaagggcaggatgtcgatttggtagagatttccccaactgctaaaccgcctgtgtgcaaactgatggattacggtaaatacaaataccagcaggccaagaaacgcgacgaagccaagaaaaaccaaaagcaggtgcaaatcaaggaaatcaaattccgtccgggtacggatgagggcgattatcaaatcaagatgcgcaacattaaccgcttccttgccgacggcgataaagtcaaagtgacattgcgtttccgcggccgtgaaatggctcaccagcaactcggcgcgcaacttttggaacgtgtaaaagaagatttggctgaagtggcgcaaatcgagtcctttcccaaaatggaaggtcgccaaatggtgatgatgattgcgccgaagaaaaaataaagctataattctccgcttactccgattgccgcttcggagtaagttttcaattgcggcaaaaaaccgtgtcattgtgggttcaagtgtttgaaaccgatgttttaaaaccccctaatgccttatccgataacgaatggagttttcccatgcctaaaatgaaaaccaagtctagcgcgaaaaaacgctttaaagtactgggtaacggcggtgtgaaacgcgctcatgcgttcaaacgccacatcttgactaaaaagaccaccaaaaacaaacgccaactgcgcggtacctctatggtaaatgatcgcgatttggcttctgttgctaaaatgttaccctacgcttaaggagtttagaatatgccacgcgtaaaacgcggtgttaccgctcgtgcccgtcaccaaaaaatcttcgcgttagccaaaggctaccgcggccgtcgtaaaaacgtttaccgcgttgccaagcaggcggtaatgaaagccggtcaatacgcgtaccgtgaccgccgccaacgcaaacgccaattccgtcaattgtggattgtccgtatcaatgcaggtacgcgtgaaaacgggttgtcttacagcaaatttatgaacggtctgaaacgcgcctctattgaaatcgaccgcaaagtattggctgatttggccgtgttcgataaagccgcttttgcacaattggttgaaaaagccaaagctgctttggctgcttaatccaaaaaattgaaaaggaagctgcggcttccttttttctttgtttgcagaaattctatgtgattgattttctttctttaaagtctatttttttaaataaatttgcgttaaaatatagtggattaaatttaaatcaggacaaggcgacgaagccgcagacagtacagatagtacggcaaggcgaggcaacgccgtactggtttaaatttaatccactatacagaaaatttatccaatggattgaccgtgaagaaaataaggtcgtctgaagagtctgatatgtcaggctatacaggcggcctcgttgtttcaggtggtatatcattaattgacagacttgatattatggaaaatgtaaaccgcatcgttgcagaaggcattgccgcagtagaagctgcgcaagacttcaacgctctagaacaaatcaaagcccgttatcttggtaaaaccggcgagttgaccggacttctgaaaactttggggcaaatgtcgcctgaagagcgcaaaaccataggtgcgcatatcaatgaatgcaaaaaccggtttcagacggcttttaatgccaaacgcgaagccctcaacgaagtcaagctgcaagcccgacttgccgccgaagccctcgatattaccctgcccggacgcgctcaggaaggcggcagcctgcatcccgtaaccctgaccttgcaacgtgtggtcgaactctttcacggaatgggtttcgaagtggcggacgggcctgaaatcgaagacgattttcacaatttccaagccctgaacatccctgcaaaccatcctgcccgtgcgatgcaggatacgttttacgttgaaaacggcgatgttttgcgtacgcacacttccccgattcaaatccgctatatgctcgataaaaaagagccgcccatccgcattatcgcccccggccgcgtttaccgtgtggacagcgatgccacgcactcgcctatgttccatcaggcggaaggtttgtgggtagaagagggcgtaacttttgccgacttaaaagcagtgttcacggattttatccgtcgcttctttgaacgcgatgatttgcaagtacgtttccgcccgtctttcttcccgttcaccgaaccgtctgccgaaatcgacattatgggcgaaaacggcaaatggctggaagtaggcggttgcggtatggtacatcctaacgtgttgaaaaacgtcaatatcgaccctgaaaaatataccggtttcgcctttggtattggtctcgaccgcttcgctatgctgcgttacaacgtgaacgacttgcgcctgttcttcgataatgatttgaactttttgaagcagtttgcgaaatgatcgtgcagactgcctgaatatggaaaagcagcctactcttggttttcaggctgcttaggaaaattcaaatgtaagatataaaacatttgatattttgttgtgaaattacattcctaattttgtttaaagaggcataatttattgctttgtagagattatatagttaatttgggtttggttctatgatgataggggcttctttgttttcgagtgcagggattgcagaaacctacttgcataatgcgggtattaagattatagctgcaaatgaattggtgccagaacgtgctaatttatataaagctctatatcccgaaagtaaaatgattataggtgatatacttcatgaggaagtgtttcaaaatttaatacagagcgtgccgaatcgattagattttttaattgcttctcctccttgtcaaggcatgagtgttgcagggaaaaatcgtaacattcaagagatggctaatgataaacgtaatcatttaatattcagagtaatcgaatttattttattaaaacgcccaacttttgttttgattgaaaatgttccattttttttaaaaattaagttaccttataaggggacattacaaacagtagaagtaattttgcaagatttatttggttgcgaatattatattcaaactcatatttttgattctgccgattatggtgttgcacaacatcgtaaacgagctattattcgtatgaataaacattcaactatttggggaatgccggaaaaagttacaaaaaccatttctgttcgtgatgctattagttttttgcctagtattgagtctggacaaaagtctaatgtgaaatggcattttgcacgtacacatgctccggagcacattatatggctaaaaaatacgccaacaggacgatctgcttttgataatatagaacattatccaaagaaaaaaaatggtgaaaaaattaaaagttataatacaacttatcgccgtatggagtgggatgctcctgccccaactattactattcgtaatgacgctatcagttcacaattaaatgttcatcctggacggtctatgcctgatggaacatattcagatgcaagagttttaacaccattagagttaatgcttttaacatcattacctattgattggaatattcccgacgatacatcagaattattaattcggcaatgtattggtgaatctattcctccattgttaattaaaaaaattgtagagagaataggaaaatagatatgacaactgcgcgctgggtaatagataaacatttacagaattttcatattttatgtaaatttgcaggtattttgaaaacaaattcttttatatctgtagaggataaagctaagttatctgaaaaattggaaaaactagatttataccatagacgaaatacaggtaaatcattggatgctactactcataaaataaaagaattatcattctatatgtttggttatcgtgatgtgtgtgggcaagttacacagaaattcctgttcagtccattgggtaatttatttttgaaacacttggataataatgaatatattcaaaaaatttttcttactatgttgtgggcgataccatttcctcatccgtacattaagactgatgaaagtattcaattatatcccatgagactaatatttaagttgttatctgatgaaagattggattgtaaactattttcttatgaatatatctatttaatttcatttgtgaaatctgctgatcagaatagctatgaaaaattagtacaagacattttggtgttacgaacatgtgctgaagtaaaaattaaacatcaattaactgcggaaaatagtcgtagtcatgcttatgtaaatgcagcacatgagtgggaatcttatttttcaaaaacattgactgatgcaggtgttttgcaaaaaacagatggtaaaattatttgccgtctaaagcatggtaagaccgaaacatatcgtaaagtaacatcaagtgagttttcgattcctaagcaacttcaggaatttgtgaaaaaattgcaaagtgcttattcgttttcagaaatgccattaaatctgaacgatagtgatcgtttgaaaattgatgtcattaaggaaatttatagcttctatccaaaagagttattggaggaaattggtgagcttaaggatgaagcagcatatgaattattgcacttacctaggttgattgaacaatatgcagataataataatggaacagaggcatatctatttgaagatgttctagaaatggggttcaatatgttttataacgtagaagctaaaaaaattggtggaccaggtaatacggatttagagtgcttatatattacgcaaaagagaaaatttgcagtggaggcaaaatcaactaaaaataagttatcaggtattaattcaggaagattggaagatcataaaaataaaattaaggccatttacacaattgttgtcacaccacgttatgtccctgccgtattatccgatattcgtaattgcccaattgtaattattcgtgccaatacatttgctgaatttttatataattgtttgattaatcgctccagtattccagagattgattatcggtattttgatgaaattattattaaaaatcttggaaaagatattagttcagaaatttccaatttgactatgcaacagtttgcaagtaacaccacaatggaagcgtatagtacatgataactatttcaaatgaagataacatgatcttaatgtctcggtatcctgacaagtattttgatttggcaattgtagatcctccttatgggattttgaataaaactaaacgtggtggtgattataaattcaatatgaatgaatactcacaatgggatattaagccagaccaaacttactttaatgaattatttcgcgtgtcaaaaaatcaaattatttggggtgggaattattttggcgagttatggttgagaagtgaatataataaaggatttattatttgggataagaatcaaccagagacattaaataatttttctatggcggaaatggcttggtcgtcattcgataggccatctaaaattttccggtttagtgtgcggaaaaatcgtaataaaactcacccaacacaaaaaccagtcgaattatatcagtggttgttaaaaatgtatgcaaagcagggtgataagattttagatacacatttaggaagtggaactcttgctattgcatgctgcattgcacagtttgatttgacagcttgtgaaatcaattccgattattaccaacaatcgattgagaaaataaaaaataatttacctgaagctagaatcagttttgggcatccaggttattgtattattgaataacttaaaaatatagagaaattaaccatgcaattctcctactcatggctgaaaacccaagccgataccgaactttcctccgataagctggaacatctgttaacgatgtccggcttggaagtggaagaggctgaaactgccgcgcctgcgtttgcgggcgtggtgattgccgaagtgaaatccgttgaaaaacatccggatgcagaccgtttgaacgttacccgagttgatgcgggtacgggcgggttggtgcagattgtgtgcggtgcgccgaatgtgaaagcgggcatcaaagtgccgtgttcgctgccgggtgccgttttgccgggtaatttcaaaatcaagccgaccaaaatgcgcggcgaggtgtcggacgggatgttgtgttccaccgacgaactcggtctgcccgacgacggtgtgaacggcctgcacattctgcctgaagatgcgcccgtcggtaccaatatccgcgaatacttggatttggacgatacgctgtttacgttgaaaattacgcctaaccgcgccgactgcttgagcatcaaaggcattgcgcgcgaagtgtccgcattgacggggtgcgcgttcaggcagcccgaaatccataccgcgccgatcacgggcagtcgaaaacagcccgtgcagattaacgcgcctgccgattgcggccgttttatcagccgtgtgattgaaaacgtgaacgcgcgcgctactacgccggattggatgaaacaacgtttggagcgcagcggcatccgcagtatttccgcgctggtggacatcggcaattatgtgatgctggaaatcggtcagccgatgcacgtttttgatgccgacaaactttccggcagcctgcacatccgccgcgcgcgcgaaggggaaacgctggaatgcctgaacgagaaaaccgtttccctgtctgaaaacacgctggtcgtggcggacgaaaaaggcgtgttgagtttggcgggcttaatgggcggcgcggcgagcgcggtttcagacggcacgcaaaatatcgtgctggaagcggcttggtttgcgcccgaaatcatcgccggcaaatcgcgccaatacggtttcggttcggattcgtcgttccgcttcgagcgcggcgtggattaccgtttgcaggcggatgccattgaacgtgctaccgaattggtgttgcagatttgcggtggtgcggcaggcgagatggtggaagcgcaaggcgaattgcctgaagcgaagcaggttggattgcgtttggaccgtctgaaaaccgtgttgggcgtggacattcctgccgaacaggtggaaaccattttgcaacacttgggcctgcagcccgagaaaacggcggaaggcttccgcgttaccgcgccgagcttccgttttgacatcgaaattgaggctgatttgattgaagaaatcggacgcgtttacggctatgaaaacatccccgacgattacacgtcaggccgtctgaaaatgctggaactgcccgaaacacgccgcccgcgttttgccgtttacaacgaaatggcggctcgcggttaccgcgaagtggtcagctatgccttcgttgacgagcagtgggaacaagattttgccgccaacgccgaccccatccgcctgcaaaacccgctggcggcgcagtatgccgtgatgcgttccacgctcatcggcggcttggtggaaattctgcaaaacaatctgaaccgcaaacaaaaccgcgtgtgcgtgtttgaaatcgcccgcgtgttcagcaaaggttcagacggccagtttgtccaaaacgaacgcatcggcggattgtggtacggcgcggtcatgccggaacaatggggcgggaaaacgcgcaatgcggatttttacgacatcaaggcggacgtggaaaatctgttgaaaaacaaagcagtcgagttcgttaaaaccggacatcccgccctgcatcccggacgtgccgccaatatcgtttcagacggcaaagtcatcggctttgtcggcgaactgcatccgaaatggctgcaaaaatacgacctgccgcaagcgccgctggtatttgaaatcgatatggcggccgtgttggaatgcgggaaaacgcgctatcgggtcgtatcgaaattccagccggtgcgccgcgatttggcgtttgtgatgccggaagctatgagccatgatgatttgctgcttgtcttgaaaggcgcggcaaacaagttggtacaggaaatcagcgtgtttgacgtgtatcgcggcacgggactgcccgaagggatgaagagcgtggcggtcaaagtgattttgcaggatatggaaaacacgctgacggatgaggcagtcgagccgcttatcggaaaactgattggcgcggcaacggcggcaggggcgcggcttcgcagttaaaaaataaatattcgcttgaattttaaataaaaattggtaataatccacaactgttacaacagaaggtaatcatatgactctcactaaagcagaactggccgatattttggtagacaaagtcagcaacgtcaccaaaaacgatgccaaagaaatcgtcgaactcttttttgaagaaatccgcagcactttggcaagcggcgaagaaatcaaaatttccggtttcggaaatttccagttgcgcgacaagccgcaacgcccgggtcgtaatcctaaaaccggcgaggaagtgccgattaccgcccgccgcgtggtaactttccatgccagccagaaactcaaaagcatggtggaacactactatgacaaacaacgttgatttgaaggttcccgcaaaacgctatttcacgctggacgagttgtgcggactgttgcaaatcagcccctatggttttgcgcaatggcagcatgatcacggtgtggttgtcggttacggcggcgaacgctacacccgtttggatgtggtgaaactgttgaaattgcagagcacgtttgcaccgtatgcagaaggtgcggaatcgggttcggacggcaaccgtccggttacgcttcaggaaatcggagacgctctgaaagacctgttggcggatttggataaggaattgtgctgatttgaggccggttgcaggtatgcagccggttttgttttacacgctaaaaaataattatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactatattgcgtgatttcacattgtttcggcttgaagcacatggttttgtaatcatttacaggcagctcgcttggagtcctgttcgggcggtttgctgtttacttaaatataaggatgacggtcaatgagatttttcggtatcggttttttggtgctgctgtttttggagattatgtcgattgtgtgggttgccgattggctgggcggcggctggacgttgtttttgatggcggcaggttttgccgccggcgtgctgatgctcaggcatacggggctgtccggtcttttattggcgggcgcggcaatgagaagcggcgggagggtatccgtttatcagatgttgtggcctatccgttatacggtggcggctgtgtgtctgatgagtccgggattcgtatcctcggtgttggcggtattgctgctgctgccgtttaagggaggggcagtgttgcaggcaggaggtgcggaaaattttttcaacatgaaccaatcgggcagaaaagagggcttttcccgcgatgacgatattatcgagggagaatatacggttgaagagccttacggcggcaatcgttcccgaaacgccatcgaacacaaaaaagacgaataaatatgaatggaatgccgtctgaaggttcagacggcatttttccggtttgaaaatatagtagattaacaaaaaccagtacggcgttacctcgccttagctcaaagagaacgattctctaaggtgctgaagcaccaagtgaatcggttccgtactatttgtactgtctgcggcttcgttgccttgtcctgatttttgttaatccactataaaatagggctgtaaccttcaatcggaatttgttgcctgcgggatatacggtatgaatgtttggtatatatgggacaggatggtggaaatctatcataagtataagaagccgtgcctggttttggcggtggattttgtgatgggtatggtattcatagagccgaatgaggagccgtgcatcggtaggtgctatgcgcctatgtcggagtcccctgattttgctaacgctgttgcgatggctgttgctatgatctgtatcgtatggattgccgttttatagtggattaaatttaaaccagtacggcgttacctcgccttgccgtactatttgtactgtctgcggcttcgttgccttgtcctgatttttgttaatccactatatctatgactgattgaagcgttgggcggaggctgcgtgaaacggtattgggcgttgggccgtctgattccaatcgggcttggggaatgcgaaacggtgtgcgcttatactgcggacgatttgtttcgcggttttgcgcccgaaacggatggagaggtgtgggaaacggtctgtcggagtagaatacgcgttttgcgtttgaatacagtaagaagaaaagagagaaacttatgccgtctgaacatcaacacatatcatcattgcttgatttcgaccgtacccatctgcttcatccctatacttccatgaccgatccgctgcccgtttatcctgtcaaacgtgcagaaggggtgtttatcgaattggcggacggcacgcggctgattgacgggatgtcctcctggtggtgtgcgatacacggctacaatcatcctgttttgaatcaggcggttgagacgcagatgaaacaaatggcgcacgtgatgttcggtggtttgacgcacgagccagcggtggagctgggcaagttgttggtcgggattttgccgcaggggctgaaccgtattttttatgcggattcgggttcgatttcggtggaagttgcgctgaagatggcagtgcaataccagcaggcgcggggtttgacggcgaagcagaatatcgcgacggtgcgccgcgggtatcacggcgatacttggaacgcgatgtccgtctgcgatccggaaacggggatgcaccatattttcggcagcgcgttgccgcagcgttattttgtcgataatccgaaaagccgtttcgacgatgaatgggacggggcggatttgcagcctgtccgcgccttatttgaagtgcatcatgcggatattgccgcctttattttagagccggtcgtgcagggcgcgggcggcatgtatttttatcatccgcagtatcttcgcggattgcacgatttgtgcgacgaatttgatatcatgctgatttttgacgaaatcgccactggattcgggcgcacgggcaagatgtttgcctgcgaacacgcggaggtcgtgccggatattatgtgtattggcaagggtttgagcggcggctatatgacgctggcggcagcaatcacttcgcaaaaagttaccgaaacgatttcgcgcggcgaagcgggcgtgtttatgcacggcccgacgtttatggcaaacccgctggcgtgtgccgttgcctgcgcttcggtcaaactgcttttgtctcaagactggcaggcaaatatccgccgcattgaaagcatcttaaaaggccgtctgaaagccgcgtgggacattcgcggcgtgaaagacgtgcgcgttttaggtgccatcggggtgatcgagctggaaaaaggcgtggatatggcgcgttttcaagcggactgcgtggcgcagggcatttgggtgcgcccgttcggcaggctggtgtatctgatgccgccctatatcatttcagacggcgttttgaccaaacttgccgacaaaaccgtgcaaatcttgaaggaacacagcaaatgaaaggcgtttacttcgtcagcggcatagacacggacatcggcaaaaccgtcgccaccggcgtgttggcaaaacaattgttgcagcagggcaaaagcgtgattacgcaaaagcccgtgcaaaccggttgccaaaacattgccgacgacatcgccgtccaccgcaaaattatgggcataccgatgcaggaagccgacaaacggcggctgactatgcccgaaatcttcagctatcccgcttcgcctcacctcgccgcccgactggatggcagggctttggacttggacaaaatccgcaccgccacacaagaattggcggcgcagtacgaagtcgttttggtcgaaggcgcgggcggattgatggttccgctgacggaaaacctgttaaccattgattatatccgtcagcaaggctatcccgtcatcctcgttaccagcggacggctcggcagtatcaaccacactttactcagtttcgccgcgctcaaacaatacggcattcgcttgcacagcctcgtgttcaaccacatccacgacagccgcgacgcacacatcgcccaagacagcctgagctacttgaaatgccgtctgaaagccgatttttccgaagcggaatggatggagttggcaaaaacagacgcggtataaagattgggaaaaatatggaacacctatttgggaaatggctgcccgacttgcccgccgccatttcagacggcatcagcctgccgatggtgcggctgctgcacacccggtcgctgaccgccgcattgcgcgccttgccgcatacattttcggtggaactgctgaaactgggcgaattggagacggaatgcggagggaggctggtgcgcgaagttttgttgaagctggaccgtatccctgttgttgaggcaaggagcgaatgccgtatcggttcggcgttttggcaaaacattttggactgcggcacgcgtcctttgggcgagcgtctgtttcaagccgatttggaaggggcgcgttcggcgtttgagtttgccgttgccggcgaaggatgcggacggtactttgccgcgcggcgttctcggttttcccgtcacggcgaggaaatgctgctgaccgagtattttctgcccgaactgaaacgttttatcggataaaataccgttttttcaagctgcgcggcaatatgaatcctaaatcccctttatttttacgcctgtccgaccgtttggatgtgtacctgcgcctgatgcgggcggacaagcccattgggacgctgcttttactgtggccgacctactgggcattgtggctggcttcagacggcattcccgatttggcggtattggcggcgtttacaatcggcacgtttttaatgcgcagtgccggctgcgtcatcaacgactttgccgaccgcgattttgacggtgctgtcgagcgtacaaaaaaccgtccgttcgcacagggcagggtcaagaaaaaagaagcgctgctgctgacggcatttttgtgcctgcttgccgcattgtgcctgattccgctgaatcatctgacttggctgatgagcctgcccgcgctgtttcttgcgctgacttacccgtttaccaaacgtttttttccgattccccaactctatctcgggcttgccttttccttcggtatcccgatggcgtttgccgccgttgccggaaacgtgccgcctcaagcgtggatactctttgccgccaatgtgttatggactctggcgtatgacacggtttatgcaatggcggacaaagaagacgatttgaaaatcggcatcaaaacctccgccgtcacgttcgggcgttacgacatcgccgccgttatgctgtgtcacggaggctttaccctgctgatggcagtattgggtgcggttatcggtgcggcatgggcatattggacggcaatccccatcgtcctgctgctgcaataccgccaatatgccgccatcaaaagccgcgtccggcaaatctgttttgaaacgtttttggcaaacaacagaattggttgggtgtggtttaccgccatttttgcccatacgtttttcgcgaaataaggcagggcaatgccgtctgaagagccgtaaactgctttggacggcatttctatctgtgccgaaaagcgttaaaatatgtttttaaaacgctgtgttatgtcagcccgtaccgtatgcgggattgagatttgccccggcagtcggtacaatctttctgttttgcgatgtctgaaaagagaagcttatgagccttatcggcgaaattttgcctttgtcccatattgttttggatatggaggtaggcagtaaaaaaaggctgtttgaggaagcaggcctgcttttggaacgcgaatcctcattgtcccatgctgatgttttcgaatgtctttttgcccgtgaaaaactcggttcgaccggtttggggcagggcgttgccatcccgcacggccgtcatgccggcgtgaagcaggcgacgggcgcgttcatccgcacgcgcgaacccgtcggatttgacgcaccggacggcaagccggtttccctgatttttatcttgctggttccggaaaacgcaaccggcgagcatttggaagtcttatccaaactggccggcaagttttcccaaaaaagcatcagagaatcgctgatgacggtttcctctgcggaagaagtccgtgccatcctgactgaagaataatatgcccagtatctccgtccgccgcctgtttgatgacaaccaatacaaactgcaactcgcttgggccgccggcaattcgggtgcggacaaccgtatcggcgtagaggcggacaagcccgtcctcgccctagtcggacacctgaatttcattcatcccaaccaaatccaagtggtcggtttggcagagtcggaatatctgaaccgcctcgaatcgggggaaacgggttatcagtttggcgacctgttcgatatttctatgtctttggttattgtggcaaacggcttgccggtttccccgggactgcgcgactattgtcataaaaacgatattccactgctgacttccaaactcgaaagcccctatctgatggacgtgttgcggatttacctgcaacgcaccttggcggcatcgtccgtcaaacacggcgtatttctcgatgtgtttgaaatcggcgtgctgattaccgggcattccggcctgggtaagagcgaattggcattggaactgatttcgcgcggccacagcctgattgccgacgatgcggtcgagctgttccgcatcggcccggaaacgctggaagggcgttgttcgcctatgctgcgcgattttttggaagtgcgcggcttggggatactcaatatccgccatattttcggcgaaacttccatccgccccaaaaaaatcctgcaactcattatcaatttagtcgaggcggacgacgagtatatgaagcagcttgaccggttgagcatccgcaccgaaaccgaatccatcctcaacgtcaacgtccgttcggttacgctgcccgtcgccgtcggacgcaacctcgccgttttggttgaggcggcggtacgcaattacattttgcagttgcgcggtaaggacagtacgcgcgaatttttggaacgccatcagacgcaacttaaagaaaacgaacaacacaatgaagatcgtcctgattagcggcctgtccggttcgggcaagtccgtcgcactgcgccaaatggaagattcgggttatttctgcgtggacaatttgcctttggaaatgttgcccgcgctggtgtcgtatcatatcgaacgtgcggacgaaaccgaattggcggtcagcgtcgatgtgcgttccggcattgacatcggacaggcgcgggaacagattgcctctctgcgcagactggggcacagggttgaagttttgtttgtcgaggcggaagaaagcgtgttggtccgccggttttccgaaaccaggcgaggacatcctctgagcaatcaggatatgaccttgttggaaagcttaaagaaagaacgggaatggctgttcccgcttaaagaaatcgcctattgtatcgacacttccaagatgaatgcccaacagctccgccatgcagtccggcagtggctgaaggtcgaacgtaccgggctgctggtgattttggagtccttcgggttcaaatacggtgtgccgaacaacgcggattttatgttcgatatgcgcagcctgcccaacccgtattacgatcccgagttgaggccttacaccggtatggacaagcccgtttgggattatttggacggacagccgcttgtgcaggaaatggttgacgacatcgaaaggtttgttacgcattggttaccgcgtttggaggatgaaagcaggagctacgttaccgtcgccatcggttgcacgggaggacagcaccgttcggtctatattgtcgaaaaactcgcccgaaggttgaaagggcgttatgaattgctgatacggcacagacaggcgcaaaacctgtcagaccgctaattccgtcaaaccattatgccgtctgaaaccccgtcctccgtttcagacggcatttcaaatattgaaaagaaagaacagacatggcaatccaatggtttcccggccatatgaacaaggcgaaaaaagccatcgccgagcgtgcaaaaagcgttgatatggtgattgaaatgctggacgcgcgtatgcccgcctccagcgaaaaccccctgcttgcccagctttccaaaggtaaacccaaacttaaaatcctcaacaaacaagatcttgccgaccccgagcgcaccaaaatctggctcgaacactataacagccgccccgacacctgcgccatcgccctcgattcctccgaaacaggcgcacacggcaaaattacccaagcctgtcgtgccatgattccccaccgccaaggcatagataaacccctgcgcgtcctcatctgcggcatccccaacgttggcaagtccaccctcatcaacggcatgataggcaaaaaatccgccaaaaccggcaacgaacccggcatcaccaaagccgaacaacgcctcttcctcgccgatgacttctggctctacgacacccccggaatgctatggccgaaaatcatcgtcgaagaaggcggctacaaccttgccgccggcggcgcagtcggacgcaacgcgttggacgaagaagaagtcgccctcgaacttttagactacctccgccgccactacctccctatgttgcaagaacgctaccaagccgacaaagaccccagcagccactgggacgaaaacgtttggctcgaatggatagccaaaaaacgcggcgcagtcctcagcggcggacggatcaactaccaaaaagccgccgaaaacatcctcaccgacttccgtgaaggcaaaatcggcagaatcaccctcgaaacgccgaaccaatgggaaacttggctcaaaaaagcccgtcagaaagaagccgaactcaaagccatacgcgaagccagaaaagcagagcgtaaagggcagaagcttcggaagcataaagaatgccgtctgaaaaatatttttcaggcagcttctctctactccaaccgatttcagacggcatatccaaacccatgccgtttcagcacggatacccgtatgaccgacaaaatttctcccgacgcgctgattgaagccgcactgctgacccaaaccgaaccgctgaccgaaaaatctatgcgcgaactgtgtgtgccgccgttgtcgcaagacaaactgattgatgtgttggcgcagttgaaaacgcgttggcaggatagggcgttgcaactggtgcatacgcaagagggctggcgttttcagattgttcagacggcattcgagcggctgggcagcctgcaagaacagcgtgcgccgcgctactcccgcgccgtgatggaaacactggcgattatcgcctaccagcagcccgtaacgcgcggcgacatcgagggcatacgcggcgtggcggtgtcgcagaacgtgatgcagacttgcaggatcgggggtggattgaagtcatcggacatcgggacacattgggaaaacccgcattgtgggcgacaacggcaacgttcctcagcgatttgggtttgaacagcttggaagaactgccgccgctgaccgaactgggcgaactggttttgcccgatttgatagaaatgccgcctacggatgaagaagagccggaaaccgtaccgtccgataccctgcccaactgaaattccaaatgccgtctgaaacgcacattgcttcagacggcattgcaacaaataagcagataaaaacaagcactaagaaaaattaaggaaaaacttatttttaatttaaaaaatcttagttataattcgtatatctaaagttgatattgcttttgtcggtagaattgctaaggaatcctcacgatgcttctaacactttctttgcgtgattttgtcattgttgaaaatctgaatctggattttcaaagcggctttaccgtattgaccggagaaactggcgcgggcaagtccattactttggatgcgattggtctgctgttgggcgataaagccgattacagccaagtccgcagcggcgcaaaagaagcgcagttgtcggcgttgtttgatatttcccatttacctgttttaaaagcagaattgtatgaacaggggcttttaaacgacggagaagaagaactcagtatccgccgcattatcgatgccaaaggcaaaagccgcagctttatcaacaatcaggccgctaccttggcgcaactcaaagccgtcggtagccagcttatcgacatccacgggcaaaacgcccatcattcgcttaatcaggaagccgcccagcgcgaattgttggacgcatttgcgggtagcagggagcaggcggaaaccgtcaggcagctttatcaaaattgggccaatgcgaaaaaagccctccaagaggcgcaggaacacgccgatgccgtcattatcgagcgggagcgtctggaatggcagtttaacgaattgaatcagttggacattaaacaaggcgagtgggaagccctcagccaaagccacgacagccttgcccattctgccgagctgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaagccgaattgggcgaaatcagtgccaatatgcgcgatgtggcaggtcgcagcgacatcaatcccaacgaacttgccgcacaagagcagcgcatgggcgagctgatggggatggcgcggaaataccggatcgagcctgaagagttgcctgccaagttggcagaaatcgaagaacgcctgcaaagcctgcaagctgccgccgatttggacgcgctcgagcataatgttgcccacaattttgccgaatatcaggaagctgcccacatcctttctgccatgcgccatcaggcggcagagcgtttgagcggcgaaacgaccgagcatatgcaacaccttgccatgaaaggcgcgcgtttcgacatcgtcctgttgccttcgtcgccgacggcacacggtttggagcaggttcaatttcaagttgccgccaacaaaggcaatccgccccgtctgctgaataaagttgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccaccttccccaagtcgcatcctgcggagaaaaccactggcgggtgcgcaagcacagcgagggagagcaaaccgtcagcgaaatcagtatattggatgaaatccaacggatcgaagaggttgcccgtatgttgggcggagaagtcattaccgatacgacgcggcaacatgcggcagaattgctgcaacttgcgtcgaaaaatagtttattttaaaatcaatcagttaaaaaataactaaaaataaaagtctaaaacaatagacagaactcagataaatccgtattatcacgctttcttaatcacttgaacaagtgattgtgctgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaattcaaaatgcctccgattatatcggaggcatttctcatttctcatttctcatttctcatactgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgatgaagccgcagacagtacaaatagtacggaaccgattcacttggtgcttcagcaccttagagaatcgttctctttgagctaaggcgaggcaacgccgtactggtttttgttaatccactatattgagtcctcgagaagggaaataaaaattaacatccttatatattgagttcctgagaagggaagattaacaaaaattaacgccctttacttcatacaatcaacagggctttttcattccttccttatctaacagggggtacagaaaccgaaacggctggcagggttaaggaagtcttcgaatgttacggaacattcatcttggacagcaaaggcaatttgttaggcattccttactccttattttgggaagaaaacgttatgggtgttttcgatattttaccgtcaggattggtatgtttatttgaatatgattttctgtggtcgggacggcatgcggcaaagacttaaggggttagatccttccttctgacgatggcgcggatgatggtgcggttggggtgtagggcgtggcgcaggcgttgtgaaaagggatggggcaagcctaggatttgggctgcaatggcggcggcgcagatgggggcggtggcgagtccgcgggtgccgtgcgcggtgttgacgtaggcattaggcaggtatgggcatggggtgtcgatgcggtagtttttgtccagcgcgagtttggtgtaggtctgccgcatggcggcaatgtcgccgagtgcgccgactaggggaaggtggtcggggctgtcgcagcgtatggcggcgtgcccttggtgtttttgggggtttgggttggcggcaaacaatgattcggaaagggcggggttaaggtgtgccaatgcttggcggtttgaggcttcttcggcttcgttccatccggtatggctgctgttgggaataaaactcgcgccgtagcagtgcagtccgtgccacgacgggctgatgtagctttcgcctgaaacggcgcaacgcagttgttcggaaaacggggtggacggtgtgaggccggtttgtccgcgtatttgcctgagaggcagggcggcgaggttggtttcgggtaggtaggggctgttcgcaccggtgcagtagatgatgtgtgtggcggtaaatgtgccgtttggcgtgcttgcaatccacttttccccgtcgtgggaaatgtcggtcaagggtgtgtcttcgtgtagtccaatgagcggatggttgaggagggtgcggacgaatgcgggtggattgagccatacgccgtgttgccagtagagtccgcatgaagggtggtcgtatgggacggacagtgggataccggcgattttttcggcttctgcagatgtgatgctgcggtagaggtggttatggtgtttttgcaaacccaattcgtgattgcgttgttgttcggtgcggctgtaattgaggtggatgatgccgttgccgccccaggtttcggattcgggcaggatgtgtccgagcaggcgtttggtgtagccgtagccggcaagcaaaagttcggtctgttcggtgtcgtgcggcgagattttggcgtagagcagcccttggcggttgccgctggcggcttgggcggcttttcgggcttccaatacggtaacggaaatgccgtgtgatgctaaggcgtgggcggttgccgcgccggatatgcccgcgccgataacgaggatgtgttccggtttttgccgttcggatgtttgtggaagtgcaaaccagggtttgtcgggcttgctttcggtttgcgggatggcttcggtctgccaggaaatgtggtggaaatgttcgtgcaggtggtgggtgcgtgaagggggaaccagccagaagcggacatcgggcaggatgtgttcgatgaggttgatgctgtcgaactggaggcactgcattgcctgatccaaacggtgcttcagacggcattccgcgtccgaagcatcttgtgcggtttgaaaatcgggaatctgattatcggggaggcagataatcaggttgagcgggggtgcgtgtttgcggatggcttggtcgagtgtgcggatgtcgggaatgccgtcccatacgagattgtccatatcaatgccgtttaaagtgtgggtttgaatatcggtatcgggataaagctgttaaaatacgcgccgtttgaaggcacgcctgcgcctgccggatattgtatgccgaaccgaggtgttttttgaataatattcctgttgaaatccgtttgttgaaaaaccgtaccgtgttggttttgacttatggggacgaacctaaaaatctgcctgccgaatttttacgcgtctattcgccgagtgcggaagtgcgcggacacggcgtgggacaggatgttttgcagaccggcaaggcggatgtccaaatcgcggatttgcagcctgtcggacagtacgcgctgaaaatcagtttttcagacgggcacgacagcggtctttacgattgggcgtatctgcacagactggcatacggatacgatgcgatgtggcaggaatatttggacaaattggcggcggcgggcgcgtcgcgttttgaagagaaataagaccggtcggatggtaatctgacgggcaaaggtatcagagaggtggttagaatatgggcggacagaaaacgcatttcggattcagtacggtcaacgaagatgaaaaagccggcaaagtggcggaagtgttccactccgtcgccaaaaactacgacattatgaacgatgtgatgtcggcagggctgcacagggtgtggaagcatttcaccatcaacacggcgcacctgaaaaaaggcgataaagtgttggacattgcgggcggtacgggcgatttgtcgcgcggttgggcgaaacgggtcggcaaggaaggcgaggtttggctgaccgatattaattcctctatgctgaccgtcgggcgcgaccgtctgttgaacgaaggcatgattttgcccgtatcgcttgccgatgcggaaaaactgcctttccccgacaattatttcaacttggtttccgtggcgttcggcttgcggaacatgacgcataaagatgccgcgctgaaagagatgtaccgtgttttgaaaccgggcggcacgttgctggtgttggagttttccaaaatctacaaacctttggaaggcgcgtatgatttctattcgttcaagctgctgccggtcatgggcaggctgattgcgaaagatgcggagagttaccagtatcttgccgaatccatccgtatgcaccccgatcaggaaactttgaaacagatgatgctggatgcgggcttcgacagcgtggattatcacaatatgagtgcgggcatcgtcgcgctgcataagggcgtgaaattttaaacggactggctgtgcagccaatgccgtctgaacacgtttcagacggcatttttgtgtttttttgagaaagagattttaaatcttaaaattaattcacatatccatcaataatttataaattttttaaaaaataggaacaattatcatttgcaagattgggagatgtctgtataatgcagtcaatccagtaaacaacgcagcagacgaaaggagggaaaaatgccggaaagtattttcaaacagatttcccttgatattttgaaactgcatcgggattctgtttattcgctgcttgccacttccggctgcaactgtcaggtgcatgaagcggcgtatgtcaacatcgacggcaaatattatattgcgctttcatgcgagcccgaggtgggggaagtcaaaacaggcattttgctgattgaggatgaaagccgcaaccttcgtttgagctgggtcggcagtgcgcgggagcttgactgcaaggataatgcctacaaacgcgccctgtccgcgttgtccagaaagctggggcggtgtaaggacaggctgcatacggcggttcaaccgtttctgttggagctggtaccggagaaaggcagattttctgtcggcgatgaagaagtttggatttctcgaaacgatttagtgagggctttatatcctgtcggatacagtatgcggcaggcagtgtttcagatttaaagttttggtagtggtttgtgttccttttgcgcccccttttccaaggggcgatttttttgcacgcgtgttggcggcaaaggaaaaatgccgtctgaaaggctttcagacggcatccgcgtgcggaattacctgtccggtaaaagacggataccttgattgcccagccgttttgacaattcggcaacctttccgtgttttcctaaaacaaaatcagggaggatttctgccaaagggcggatgacgaaactgcgttcgtgcgcgcgcggatgcggcagggtgagtcgggtgtcgtcgctggagatgccgtcaaagtcgataatgtccaaatccaatgtgcgcggcgcgttgcggaagctgcgttcgcgtccgaaatcagcctcgatacggttgagttcggcaagcagggcaatgccgtccagagtggtggaaacggtgcagacggcattgacaaaatcgggctgattgtcgtaaccgacgggcgcggtcatatacagtgaggaagcctgtttaagacggatgtcaggatgggacgacagcgtgtccaatgcggcgcgtacctgttgggcagggttttcaagattactgcccagggcgatgacggcaaaatgtctgttgttcataacggtgtttcagaaaggcaggactttggttttggcaaggtaaacgatgcaggcgacgcaacacatggcgagcaggtaaacggtgtagaacttggtcgaacgcggacgggcgcgcatcatcatcatacccaatgcgatataggcgagcagaagcaggatttttgtaccgagccaaggcgcgttgaacggggagaaatgggtaattttcatcagccacaatcccgtaaacagcagcatggtgtcgttaaggtggggcagtgccttccaaaagcccgccaagggcttttctggatttttccaaagtaggaaaaaacggatgttgaataccaaaatggtgatggtaacgaagatttggtggctgtatttgacaatcagatactgcatggtcggctcgtatcaaaataagggttagaatcggcttattttaccgcaaacagttatttttgacgcagtttttcaaataccaaaagatagggtgggctgtttttccggttggtaaagccgtaacgcaaaacggcaaactgttcttgaggcaggttttttgcccattgttcgattgcttctgcctcctgtttgccgttttcgtgtcccggatagaggacggcaataagcataccgttttctttcagtagggataaggtggcagaaagggcggcaatgctggtttccgtgcgggtggtaaggcttttgtccccgccgggcagccagccgaaattgaaaatggctgcatccagcggctttggaatatattgcttcaggttttcatgtccgtccaagatgagccgtacattgctgtaacctgcttcctgcagacggcatcgggtgttgttcagggcttgcggctggatgtcgaatgcccacactttcccccggatgcctgcggtttgtgcgaggaaaagggtgtcgtgtccgttgccggcggtgccgtccaaagcattgccaccttcgggaagtgccttccgcaaaaggcaatgggcgaatggaaggatgttttgcaataacatttttaaatgctgtctgaaaataaaaataccttaccgttgtccggtaaggtattgaaagatatgacacgtcatgcttcgtgcggattattcggcaggctgctggacggtttccacttggacgagggtcgaagtcggtgcggcttggggtctgttttcatgttgtaggttgacggagcgtgccggtacgatggtggaaatggcgtgtttgtaaaccatttgggtgacggaagtgtttctcaggagaacaacgtattgatcgaaagactcaacctgaccttgtaatttgataccgttaactaagtaaatcgaaaccggaacgtgctctttacgcagggcgttcaggaagggatcttgcaacatttgtcctttagctgtcatatttttaactccgttattatgattgtgaaatcgggcagacgccctgtgcgtgtcgaattgtagccttgaataggaaaaattaccaattttttttgtgtttgggcggttttccgccgggcatttgtatgtcaggagcgttgctgcagcatccacgattcgattttgcgggcgtcgttgacgcgtgtggcggatgtgggcgagttcagcaatacgatggtaacgggttggttttgaatgttggctttgacaaccatagacctgcctgcttcgcgtatgtagccggttttctgcaattcgatgttccacatgccttctctgaccagggcattggagtttttgtagttctgctgcccgtttttggtctgtaccgaggcgtagttggaagtcgagttggtgcggatttgcggatattgggcggcggcgttgaccataaggctcaggtctttggcggtagaaacgttttggaagttgagtccggtcggttcgtaaaagcggctgccgtacataccgaggctttgggctttgcggttcatggcggcgacaaatgcgcccatgccgccggggtaggttctgcccaatgcatgggtggcgcggttttcgctgctcatcaggctcaggtgcagcagttttttgcgtgtaagtgccgtacctatggcaagacggctgccggtccctttgatgcggtcgatttcgtcgggcgtaatggtaacggtttcgttcatgtccaagtttgcatccaaaacgaccatcgcgctcatcagtttggaaatggaggcgatgggcataatcctgtcggcgtttttctgatacagtatctgtccggttttgttgttgacgaccagggcagactgtgaggagagaatcagaccgcctgtaatggcttgggtgttggtggggtgtatcgtgctttcggcgaatatttctatcggatcggaggaggtaagcatgttctgttctaaaaattgccctaaaatgtcgttgtcggcaaaaaggtgggctgacggcagggaaaggcagagaccgagcagcagcgatgagggcaggcgtttcagagtatggatggacatttttgattccatatttttgagtattggcgttattttgttgaaaaaacagccatctgtaaagtatgtcgtctgacaggagactgcccgtaggcgggcggtcttgttgtgttttggggattgggttttataacattctgtttttaaatcggaacatattttgtggtttgacatggatatttttcatgccgtcgtgtgtcggtttggatgtttccggcggttgaatccttgtcctttggggcggtagaatcggggttggtttggcaattgcggcggtgcgtctgcgtgccgttttgaataatgggaatatcgggagtaggactatggatgtgaaatatgaatttaccctgccttcgagcagcggtgcggattttcattcggcagaacatctgcctttggtcgtgtatttttatccgaaagacagtacgctgggctgtacgacggaaggcttggatttcaatgcgcgtttggaacagtttgaggcattgggttataccgtggtcggtatttcccgcgacggcgtaaaggcgcatcagaatttttgcgccaagcagggtttccggttcgagctgttgagcgacaaggatgaaacagtgtgccgcctgtttgatgtcatcaaattgaagaaactgtacgggaaagagtcgttaggtatcgagcgcagtacgttcgtcttgaataaggatggagaaatcgcccatgaatggcggaaagtcaaagtggcgggtcacgcgcaggaagtattggaaacgctttcccgataatgtgaaccatgccgtctgaagaagattcagacggcatttgtttggaacggtatggaagaaggtttgatcgacaggctgcttgaaacgctgtggttggacaggcggctcagtcagaatactttaaacggttaccggcgcgatttggaaaaaatcgcccgccgcctgtcccaatcgggcagaatgctgaaggatgcggacgaagcggatttggcggcggcggtttatgttgacggagagcaacggagttcgcaggcgcgcgcattatcggcatgcaaacgcctgtatatatggatggagcgtgaaggcataaggacggacaatcccacccgtttgctgaaaccgcccaaaatcgacaagaatattccgaccctgatcaccgagcagcagatttcccgactgcttgccgccccggataccgacacgccgcacggtttgcgggacaaggctttgctcgaattgatgtacgcgaccggcttgcgcgtcagcgaggcggtcgggctgaacttcggcaatgtggatttggacaggggctgtattaccgcgctgggaaagggtgataagcagaggatggtcccgatggggcaggagtcggcgtattgggtggaacgctattatacggaggcacgcccacttctgctgaaaggcaggaattgcgacgcattgtttgtcagtcagaaaaagacgggcatttcccgtcagttggcatggatgattgtcaaagaatatgcaagtcaggcaggcatcgggcacatcagcccgcacagcctgcgccacgcctttgccacgcatctggtgcggcacggcttggatttgcgcgtggttcaggatatgttgggacatgccgatttgaatacgacgcagatttatacccatgttgccaacgtatggttgcagggtgtagtgaaggaacaccattcccgaaactgaggcttctactttggtttaataagaaatcaatcgaaaatgcaaacttgataaaaaattaccaagacaaaccgtgtataccgaccttgcaatgcgaaccgtttttatttatattcgcatacgataataaaagccgctatcggtacgatagtttgagaacacacggagcacaaaatgtttgtctgcatctgcaatgccgttaccgaccatcaaatcaaggaaaccatcgccgccggcgcgaccacaatgggcgatttgcagtcgcaattgggcgtagcgagctgctgcggctgctgcggggagcttgccgcttcgtttctgacggcgcacaatgcgcaaccgacggttacggcgggtatcaacgttcaagcgtaaaacggttttcgaaatgccgtctgaactgttcagacggcatttttactgtttttggcaggacttgagtatcatcttcctcgaaaacattgttttttcccaaatagaccatgattctgctgcgtctaaggctttggcgtgtgcaaattgacagataaggaaacgcggatgaaattgaccttgatgtttcgtgaatattgcagcttgtgccacaaaatgcgcgacgaactcaaaccttttcaggatgaatacgggttcgggctggaagtggtcgatgtggatgaaaatcctgttttggaagaaaaatacaatgagctggttcccgttttgttggcgggagatgaggaaatctgtcactggtttttggatgaggacaggttgaaacagtttctcgaacggtaaaaaaatgccgtctgaagcaggacttcaggcggcatttttttcaaatcaacgttctttacgtttttgcggggcggatgacctgccggtaaaggaagcacgtttggatgcttggtaaattgctagtcttcttcgatgttgcatattaaccctttctttattttatttgtcggttgggaggattcttatttattgattttttcaataaaaattagaaaatttattgtgagatgttattgttggcaatcatatcatgttttactgttgatggaagcatgattgtgtaaagatgatatgtgtttgtgtaatcggtagattttatagtggattaacaaaaatcaggacaaggcgacgaagccgcagacagtacaaatagtacggcaaggcgaggcaacgccgtactggtttttgttaatccactatataagaaaaccgccaaggcggtgcttgacggcggaaacagaggggcgggcggcatcagagcagcttggaaacgacctgtgcaaggctttttgccagtctgacggtttgatgccgaagtcgttttcgattttgcggcagtccaaaatgctgtatgcgggcctgggggcggcggtcggatattccttgtctgaaacggcagtcaattcgggaacggggaaggatgtctgctgttgcgatgccgcttggaaaatatgttgggcaaattcgtaccaggatacggatttgctgccggcgtagtggtaaatgccgcgaacgggattggagtgctgcaacaggcggatgatggtggcggacaagtcgccggcataggtcgggcagccgatttggttgtggacggcggacagcggggaacgttcccgcgcaaggttcagcatcgtgcggataaagttgtccccgtattcgctaaacagccaagaagtccgcaggataaggctgtcgggattggcagacagtgcgagcagctcgcctgcggttttggattgtccgtatacattggaaggattggtaaagtcgctttcctgatagggtcttttccctttaccgtcaaagacatagtcggttgagatgtggatgaatcgggcatgggcgcgatgtgctgccaaggcaaggttgtaaacggcggaagcattgacggcaaatgccgctgccgcatcgccttccgccttgtcgacggcagtataggcagccgtgttgacaatggcgtcgggttggaaacttttgaccatgttgcagacggcatcggcatcggtaatgtctagggatgcggaatccgtcgcaatggtttcccagtcttccggaagacggtcgcgcaggcagcgtgccagttggcttttcgagcctgtcaataggattctcatgaggtatttcctttggtaaaagtgtattgtaggacttgctgtcggtattatagtgccaaaattttgccgacggttgacgggttggctttttgtgccatgggtattgttttgcgccgacttcggctagaatatcggtttgtgattcaaacctgtcgggtgtcgggtcggtattttcaagatattttcaggggggggcgaaatgagtgagattggtttggtaaagatctattttggaaaagtgcgcgatttatatgaaatcgacgataaacgtatgctgatggtcgcttccgaccgcctgtccgcgtttgatgtgattttggacgacccgattccgagcaaaggggagattctgacgcagatttccaatttttggtttaaaaaactggcgcatattatgcccaaccactttaccggtcaaacggtttacgatgttttgcctgaaaacgaagccaaagctttagagaaacgcgccgtcgtggctaaaaagctcactccggtgaaagtagaggcgattgtgcgtggttatctggcaggcagcggttggaaagattatcaaaaaaccggctcggtttgcggtattcaactgcctgaaggtatgcaggaagcgcaacaactgcctgaagtgatttttacgccctcaaccaaagccgcagtcggcgatcacgatgaaaacatcagctttgaagaatgcggacgcattatcggcaaagaattggcggaagaagtgcgcgccaaggcggttcggctttacaccgaagcggcggaatatgccaaatcgcgcggtattattatttgcgataccaaatttgaattcggtttggatgaaaacggtacgctgacgctgatggatgaggtattgactcccgattcgagccgtttttggcctgccgaccaatacaaagtcggcaccaatccgccgtcttttgacaaacaattcgtccgcgactggctggaacaaagcggttggaacaaaaaagcccctgcgccgaaagtgcctgccgatgtgattcagaaaactgtcgagaagtatcgggaagcattgactttgctgactcaggattgatttttaagtttgaaggccgtctgaaagaaatatggttcagacggcctttttattgtatcaatactggattttaaggatggttgcctttataatccgcaattgctttcagcgtccgaaatgccgtctgaaagcttgtttataacctgccgcacggtctgaaaccctaactatgcacattcggattttagtgtgcattattagtgttttagcagtgcggtattttgaaaggaacaatgatgttcgacaaacacgttaagaccttccaatacggtaatcagaccgttactttggaaaccggcgaaattgcccgccaagccgccgctgccgttaaagtctctatgggcgacaccgttgttttggttgccgttaccaccaacaaagaagtgaaagaaggtcaagacttcttccccctgaccgtcgattatttggaacgcacttacgccgcaggcaaaattcccggcggtttcttcaaacgcgaaggcaaacaaagcgaaaaagaaatcctgaccagccgtctgatcgaccgtccgattcgtccgctgttccctgaaggtttctaccacgacatccaaatcgtagcgatggtcgtgtccgtcgatcctgaaatcgattctgatattcctgcaatgttgggtgcatctgccgcgctggtgttgagcggcgtaccgtttgccggcccgatcggcgcggcacgcgtcggttatgtaaacggcgtgtacgttttgaatccgactaaagccgaattggcgaaatcgcaattggacttggtggtcgccggtacttcaaaagccgtgttgatggtggaatccgaagccaaaatcctgcccgaagacgtgatgctgggcgcggtggtttacggccacgatcaaatgcaggttgccatcaatgcaatcaatgaatttgccgacgaagtcaatccggaactttgggattggaaagcacctgaaaccaatgaggaactggttgccaaagtccgcgggattgccggcgaaaccattaaagaagcgttcaaaatccgtcaaaaacaagcgcgttctgccaaattggacgaagcttggagtgcggtaaaagaagccttgattaccgaagaaaccgacactttggcagccaacgaaatcaaaggcattttcaaacacttggaagccgatgtcgtccgcagccaaattttggatggccaaccgcgcatcgacggccgcgacacccgcaccgtccgtccgctgaacatccaaaccagcgtattgccgcgcacgcacggttctgcattgtttacccgtggcgaaacccaagctttggccgttgcaactttgggtacttcgcgcgacgagcaaatcatcgacgcgctgtccggcgaatacaccgaccgctttatgctgcactacaactttccgccgtactctaccggcgaagtgggccgcatgggcgcaccgaaacgccgtgaaatcggtcacggccgtttggctaaacgtgcattgttggccgtattgccgaaacctgaagatttcagctacaccatgcgcgtggtctccgaaattaccgaatccaacggctcttcctctatggcttccgtctgcggcggctgcctgagcctgctgtctgccggcgtgcctttgaaagcacacgttgccggtatcgcgatgggtctgattctggaaggcaacaaatttgccgtcctgaccgacattttgggcgacgaagaccacttgggcgatatggactttaaagtggccggtacgaccgaaggcgttaccgcgctgcaaatggacatcaaaatccaaggcattaccaaagaaattatgcaaatcgctttggcacaggccaaagaagcgcgtctgcacatcttggatcagatgaaagccgccgttgcgggcccgcaagagctgtccgcacacgcgccacgcttgttcacgatgaaaatcaaccaagacaaaatccgcgaagttatcggtaagggcggtgaaaccatccgttcgattaccgctgaaaccggtacggaaatcaatattgccgaagacggtacgattaccattgccgcaaccactcaagaagccggcgatgcggcgaaaaaacgcatcgagcagattactgccgaagtggaagtgggcaaagtgtacgaaggcactgtggtgaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgagtaacgcttagggtgaaagtgccgtctgaacaggtttcagacggtattttttacgggtatcgggaatgaatggggcttacagccacaggacggcaagtttccataatgcccataatgatacggataatcccgtacacaggcggatatatcggttttgcatgatttttttcagttgcagggaaaaaatgccgattgctaaaagattgggcagcgtacccagtgcaaaggcaagcatatataacccgcccgttgccgcactaccgcttcccagcgcgtaaagcgacgcgctgtaaaccagtccgcacggcagccagccccataatattccgaccgcaaggcaggcgggtatggattttatgggtaacagccggttgagtatcgggttcaggttccgccatatcggtttgccgattttctcgatttttgccgccaaggaagaaataccgctcaagtataagcctaaaaagagcagcaggaggttggcggccgtgtataaaatattctgcaggacgcgggtttggtcgagtgaaacgccgacctgtccgattaatccgagtatcaggccgattgccgtatagctgcttacccgtcctgtgttaagcagcaggatcagccaaaagcggttgatatgcggggggagttggagcgcaaacgcgctgcttaatccgccgcacataccgatgcagtgcgttccgccgaagaaaccgagtaggaacagggtgaggaaagtgatgtcgtggttcataggcagtttgaagtcaaatatttttcgggaaaagggatgatttgcggcagtccggcacataggatccgccgagggcattgcccgtgctgttaaagtcttgaataaggatgcagtttgcaccctgtatttcgataattttgtaaaatccgccctttactgcgccgtcggcgggtttgccgtgtgcgtcaaaatacaggatggtgcggttttgaagatgcgcgcaatttgaaacggccgggtttgccggtatgtttcgggtgcaggcggcaaggattgcacaagggaaaagcaacagtaatatgcggaacatggtgtttcttgtaaggggtaacaaacagtataatggctgattttaatcctcaggcggcgggagatggaagcatttcccttcggtgcgggggatttcggattcggaagcaacagacgatacgggatttcggaacaatatgaacactttgaaatttaccaaaatgcacggtttgggcaacgattttatggtgattgacgcggtcagtcaggattttacccccgaggacgcgccgattgcggaatgggcggaccgcttccggggcgtgggcttcgaccagcttttggtggtcgggcgttcggaaaccgaaggcgtggatttccgttaccgtattttcaatgccgacggcagcgaggtcgggcaatgcggcaacggagcgcgttgttttgcccgttttgttgcagacaagggtttgaccgataagaaagaaatttgtgttgaaacggcaaatggcgttatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaacccccatgcggtgattgtggtcgatgacgtggaatgcgcgccggtgcgcgaaaccggttcgcttatcgaaccgcacaggcagtttcccgaacgcgtcaatgtcggctttatgcaggttgtcggccgaaccgcgattcgtttgcgcgtgttcgagcgcggcgtgggcgaaacccaagcttgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaagcggtgtttgaaggtgagttggcgtattcatgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataatacggtgcggccgtatcggaacaaaaagttataaagaaagaaattttggatattggttttttaggcggcataggtttaggataaagccatatccgaaatttgtttatgtttcggcgcaaatcccctgcaatcggacaggatgcctatggggattgcgccttactgtcgaaaccttattattcaggagcagaagatgaaaattgcaaacagcattaccgaactaatcggcaacacgcctttggtcaaactgaaccgtctgaccgaaggtttgaaggcagaggttgccgtgaaactggaatttttcaatccgggcagcagcgtcaaagaccgcattgccgaagcaatgattgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaaggtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataatgctttaatcggattgtcgaaacattcagacgcatttttcggtatcggtgtaacgccgtgccggaaaatgcgtttttgcatatatgccgaaaacgccggttgtgttttaatcaggtgttggtgtcgccgcatcgcttgagggaaatattttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattcgggttttatttggcaggacggttttttgccccaacggaaaatagcctgcctgcccgtaaaatcagccgtttgtccgggtgcagccggggctttgggcttcagacggcatattttcggaatggcggcattcttgccgtcggcgcggcagccgtatggggaagggaggggatattgtggtcggtaacggcaaaaaatatgccgcaccattgctggtgctgggttgcgtggtgttcggtctgggcagtctgattgtcagatccgtccccgtcggttcgtatgcaatcgcattttggcggttgctgatttcggtgttcgtattttggtttttagcacggtttttcaggcaaaaattcccaaaaaacaggaaaaccgtccgatatgccctgacggcgggcgtgtttctcgctttcgatttggcgttgtggcacgaaagcatacacgcggtcgggccgggtatttccaccctgctcaacagcctgcaaatctttttcttgtcggcaatcggtgttttctttttcggcgagcgtttgagcgggctgaaaaaggcaggcttaatatcggcagttgccggcgtggcgatgattgccggtgcggaattcggctacaacggtaatgcggtttggggattcgccagcggtttggtatcgggactgatgctcgccctgtcgatggtgtttgtccgcaaaacccatgaaatcgagccggtggcgcttttcccttcaatgatgattttgagtttgggcggcgcggtatcgctggttgttccggcattgctgatggatggcggcgcgctttatccgacgacttggaaagatgcgggtttggtgcttgtgtacggcgtggtgatgcagtgcttcgcgtgggcgatggttgcctatgcgattccgctgctttcgctgtcgctgacggggctgctgcttttgtccgaaccggttgccgccctgttcatcgattatttcgggttgggcaaaccgattgaaggcgtgcagtgggcaggggtggcgctgacgctttcggcaatttacctcggttcgctgaaacggcagtcttcacattgatttcatcagggcaatattggcagttcgccgtgcaaaacctgcgtatattggactgataggtaggaaaatccgacaacgttagactcgcctgtaaaagtgaggaatagcaaatgccgtctgaaactattttcagacggcattcttggcttcctggcctaacggattgccgtaccggacctgccgaaatcgccgaagttcatcaaaatgaacattgccttgccgacaaccagcttgtcatccacaaatccccagtagcgcgaatcggcactgttgtcgcggttgtcgcccatagcgaaatagcgtccttcgggaactttgcacacgaaaccgctgccgtcgtcggcatattggcagtgttccaaaccgctttgctctatggaatatccgttttcagacataatatcggaggtatatttgcccaatacgggcagggaaacggcaggctgtccttcttttttcagaatattgaaggatttgccgtctagaccgctgcggaacatatccgtgttgtggatttcggaagggtcggtgtcgtcgggataacggtatgtgccgtcaggaatgtcggaagtgggtttgccatttaccgtcaaaatcttatcccgatattcgaccacatcgcccggaatgccgacaatacgcttgatgtaggtcatctccggctgcagaggataattaaaaacaacgacatcgccccgttcgattttgcctgtaggaataaatatattgtttaaaacgggtacgcgcaggccgtaggaaaatttgccgaccaaaatgaaatcgcccttgatcaggcccgggcgcatcgagctggacgggatttggaacggttcggcgataaacgaccggatgaggaacaataccaaaacggtagggaagaaactgccgaaataatcgccgaagtggctgctttccgagatttcgggatgagtcttcaggcggtatttatataccccccaagccgtaccgcacaatacaacgaaaatcaggaaaacggcggtaaagctcataaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtttttcaagcagttttttcttacgcgtaatatcgccgccgtaacatttcgccaagacgtttttacgcagtgctttgacgttttcgcgggcgataatctggctgccgatggcggcttggacggcaatgtcgaacatttggcgcggaatcagctcgcgcattttcgatgctagctcgcggcctcggtgaaccgcgctttgacggtgcacaatcaggcttaaggcatcgactttttcgccgttgaccataatatccagcttaatcaaatcagacggttggaactctttgaaatgataatccaacgaagcatagccgcgcgaagtggatttgagtttgtcgaaaaagtccatcaccacttcgttcatgggcaaatcgtaagtcagcatcacttggcggcccatgtactgcatattgacctgcacgccgcgcttttggttacacaaagtcatgacgttgccgacgtattcctgcggcacaaggatggtcgcggtaataatcggctcgagtatggtttcgatgctgccgatgtcgggcagtttggacggattttcgacttcgattttttcgccgcttttcaacacgacttcataaatcaccgtcggcgcggtggtaatcaaatccatatcgaactcgcgctccaagcgttcctgcacgatttccaagtgcaacagacccaagaagccgcaacggaagccgaaacccaatgcttgggaaacctcaggctcaaatttcaacgaagcatcgttaagctgcaatttttccaaagcatcgcgcaaagcttcgtagtcgtggctttctacgggataaagtccggcgaatacctggctttgcacctcttggaaaccgggcagcggctcagtggcagggttggcaaccaaagtaaccgtatcgccgactttcgcctgtcccaattcttttacgccggtaatcaaaaagcccacttcgccggcttttagttcttgtttttgaactgatttcggtgtgaatacgcccagctgctcgacctgcgtttccgccttggtgctcataaagcgcactttgtctttcagtttgatggtgccgtttttcactcgaatcagcataaccacgccgacatagttgtcaaaccacgaatcgacgataaccgcttgcagcggcgcgttttcgtcgccggtcggtgcggggattttggcaacgatttcttccaaaacgtcttccacgccgatgccgcttttggcggaacattgcaccgcgccgacggcatcgatgccgatgatgtcttcgatttcctgttccacgcgttcggggtcggcggcgggcaggtcgattttgttcaaaaccggcacgacttccacgcccaaatcaatcgcggtgtagcagttcgccacggtttgcgcttccacgccttgcgacgcgtcaacgaccaaaagcgcgccttcgcaagccgacagcgaacgggaaacttcgtaagagaagtcgacgtgtcccggcgtgtcaatcaggttgagttgatacacctgcccgtcgcgtgctttatagttgagcgcggcggtttgcgctttgatggtaatgccgcgctctttttcgatgtccatggaatcgagcacctgcgtactcatttcgcgcaaatccaaaccgccgcagtattggatgaagcggtcggcaagcgtcgatttgccgtggtcgatgtgggcaatgatggagaaatttcggatatttttcattagagttgttttgaatgtcggacagtgggtttgggaaatgccgtctgaacaaacggcgttgcgtccgaatatcgggtgcaacgtggaaatagcccgttattctaacggaaaaccgctgttttggcataagtttgataaaggtcttataaagatttgacgatttctgccaccatttttgcggaatttgccgccgccgttttcaagaactcgtcaaagctgatgtctgctttttcatctgccgaatcggaaaccgcgcggatgatgacgaaaggcgtttccaactgatgacaggtttgggcgattgccgccgcttccatttccactgctttgacttcggggaagtgcttgcggatttccgccacgccttcgctgctgtggacaaagcggtcgccgctgacaatcagcccttgttctaccgccgcgccttcaaacgtccgcgccgcccgttttgccgcctcaatcaaaatgccgtctgaagcaaaccttgccggcagttgcggcacttgtccccaggcatagccgaatgcggttacgtcgacatcgtggtgtgcggtttccgtgccgatgactacgtcgccgactttcaaacccttgcccaaaccgcccgcgctgccggtgttgatgacgcagtccgctgcgaattcacggataatccaagccgttgcaaccgccgcgttgaccttgccgatgccgctcaatgcaagcaccatgcgttttcccgccaattcgccttcataggcggaaaatctgccgaaagagacggctttgacattttccatcatctcgcgcaaaagctcgatttcttgttccattgcgccgataacggctactgttttcaaagacatattgctgacctgttgtgaatttcggatagaatgcctgattatacacgctaacacggcaggattgagtggaggtggtttgtccgtgccgtctgaaacggtttcagacggcacggcgggtttttggtagaatgggaaggtacagattgtttgaagattaggggacgaggatgtttaccgatgaaaatatgaccgcaaaggaagaactgttcgcatggctgcgccatatgaaccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttccagccccgatttggaactgctctgatggcggtatggatttccggacggatggtttgaaatgatttatccgtggcataatgagcaatggcggcagattgcggaacattgggagcgtcgtcccaatgcatggctgtttgccggcaaaaaagatacggggaaaactacatttgcccgctttgcggcgaaggcactgttgtgcgaaacccctgcaccgggctgcaaaccctgtggcgaatgtatgtcctgccatctgtttggacagggaagccatcccgatttttacgaaatcacccccttgtcggacgaacccgaaaacggacgcaaactgttgcagatcaaaatcgatgccgtcagggaaatcatcgataatgtgtacctgacttcggtacggggcggtttgcgcgtgattctgattcatcctgcggaaagtatgaatgtccaagccgccaacagtttgttgaaagtgttggaagaaccgccgccacaagtggtctttttgctggtcagccacgcggcggacaaggttttaccgaccattaaaagtcgctgccggaagatggttttgcccgctccttcccatgaagaggcattggcatatctgcgtgaaaggggtgtggcggaacctgaggaacgtctggctttccattccggagcgccgctgtttgatgaggcggacggtgtccgtgcgttgcggattaaactgttggatattttggcagaaccaaggttgttgaagattttggattacgccgcgcttttcgataaggaaaaacttccgctcgccgtatttgtcgggtggatgcagaaatggctggtcgatttgggattgtgcctgcaacacatgaaacccgtctattatcccgcttatgaagacaggctgcttcagacggtatccggtttccgtccgcgcaatgtatttgcggcggaggatatgctcaaacagcttgccccctacgggtttcatactttaaatgtcaaaatgcagatcgagcatctgctcatcaactatttggaattgaagaaagagaacgggtgaattatgtcagacggacaaaatattccggcaaaaatgatgtcgttgcagctgaaagacatgaatctgctgtacagctcctacatgccgtttttggaacacggcggtctgtttgtgcagaccaacgacgtattttccatcggggacgatattctgcttgccgtagaaatcctcaacttccccaaactgttcctgccgaccaaagtcgcctggatcaatcctgcgcgtacttcctccaaacccaaaggggtggggctggcattcacaaaacacgaaaactgcctgaaagtcaaagaccagatcgaagtcgaactgggcaacacaatcggcggcagcagacctacgtttaccatgtaacgccatgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccatcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcctggcaacacaaacgctttgcagaccacatcgaagcagccaatcaaaccggactgcccgttatcgtccatacgcgtgatgcggcggcggacaccttgtctatcctgaaagaatgccgggttaattcgggcgttatccactgtttttccgaagacatcggttttgcccgtgcagcaatggatttggggctttatatttctttctcgggaatcgttacctttaaaaacgcacccttggttcaggaggcggcgaaatatgtgccggacgaccgcattttggtggaaaccgatgcgccgttcctcgcccccgttcccaaacgcggcaggcagaacgaaccggcttttgtgcgccataccgccgaacatatcgccaaattgcggaaccaaacattggaacaggttgcggcatatacgacggaaaacttttaccggctgtttaaaaaagtacccgatatgcggaccgtctgaccctgtaccgacgataaggaaaaccatgaaggcaattcatccgtatgcatgtccgcgctgctgccggctgcctgccaacacgtttcggacaggcatggcaaattccgcttccaaattctgcattgccaaaggcggcagacgggaagcaaaaaaagacgaaagcggcggcggatatgccctgtgccatttgccggacagcaggattgtcgaggagtgggaatatttccgttcacaatattgatactgcgcgatatacggcaaatattgtgggaagtttccgcttttgcgtataatgcgccctacctgacaaattttgtcaactttatcaaaaggaataagcgatggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttaccgtcaacgtattggaaaatcccgaagtgcgccaaggcattaaggaatacagcgactggccgaccatcccccaactttatgtgaacggcgagtttgtcggcggttcggacatcctgatggaaatgtatgaggcaggcgagctgcaagagctgctgaaagcctgatggattcggcaatgccgtctgaacgtgtttcagacggcattttcttttccggcaaatcaaaaaaaagtataatggcgcgtctcaaaatcacattggaacaccgcgatgaacgttaatgttatcaaccatccgctcgtccgccacaaattaaccctgatgagggaggcggattgcagcacctacaaattccggacgcttgccaccgagctggcgcgcctgatggcatacgaggcaagccgtgattttgaaatcgaaaaataccttatcgacggatggtgcggtcagattgaaggcgaccgcatcaagggcaaaacattgaccgtcgttcccatactgcgtgcaggtttgggtatgcttgacggtgtgctcgacctgattccgactgccaaaatcagtgtagtcggactgcagcgcgacgaagaaacgctgaagcctatttcctattttgagaaatttgtggacagtatggacgaacgtccggctttgattatcgatcctatgctggcgacaggcggttcgatggttgccaccatcgaccttttgaaagccaagggctgcaaaaatatcaaggcactggtgctggttgccgcgcccgagggtgtgaaggcggtcaacgacgcgcaccctgacgttacgatttacaccgccgcgctcgacagccacttgaacgagaacggctacatcatccccggcttgggcgatgcgggcgacaagattttcggcacgcgctaactgactgattttcggagttgatatgaattttcaagactatctcgccacatttccttcaatcgaccatctgggcggtttggacgttcaggatgccgacggcaaaacggttcaccacattcctgccgttcagggtaagctcggttcgctcaagctgtacaatgctttggcggaacgttttgacggaaaattgggtaaagaagcggcagaacagggtttgatatggtttgccgaacacgttgccgacgcgcgtgcccatccgggcaagcatccgaacatcgatctgctggaaaatgtcgtgcaaagcggtgaaacctggttgctcaagccgctttccgcgcaataattttcgaccatgccgtctgaaatccgtttcagacggcattttgtcggaaagaagaccgtaaaacgggcattttcttttctatttcaggatacgggcaatgatgtttcaacacacaggacgacacataaagcgccgccctatgtgttgccctaatttggaaggggttacacccttttcaaataaaatctgatgctgctgccacgaaggacggatgtccgagtggcggggtttcaaccattaaggaaatacgatgaaaaaaatgttcctttctgccgtattgcttctgtcggctgccgcccaaaccgtgtgggcggatacggtgttttcctgtaaaacggacaacaacaaatacatagaagtccaaaaaatcaaccgcaatctttacgaatattcgttcggcagtgcggcaaaaaaagaaattgccatacgcaacagcaaagctgacctgttggggcgttccgacaggtggcaaggtatgggcagcggtcgttgggcaacgatgaaattccaaaacggcgaatttatgtacaccatatggacaggcttcgattccgtgactcatacggaaagcagcggtgtcgttgtggagcgtaggggcaaggaagtcgcacgggtcggctgtacgccgaaaaccgcgcaggcgaatttcaacgatgacgatttttcctagtaatcggggcggataaggcgatggaaacagcgaaacccgtcatgctgattgtccgtccgtcgggcagggccgcagaagatgtcgaaacttgcctgaatgccggttggcgcgcggaagtattgagtccggtcgaaatcgaagcagatgctgccggactggaacttttgtccgaacaatatgcccgtgcggatgccgtgttttgggtcagtccgaccgccgttgaaaccgccgtcccgtaccttaacctttcagacggcataaaggcgcagattgccgtagggcagggcagccgccgcgcattggaacgctgtttggtcagaacggtcatcgcgcctgatgacggcaacgacagcgaggcggttttgcgcctgccggtttggaacagtctgcccgaaggtgcgcgcgtattgtttgtgcgcggacacggcgggcgggattttttgatgaatgccttgcaggagaaaggttttcggacggaggtggcagaagtctatttcagacggcataaacctttgaactttcaaaatttccaaaccgaaaatattgccgccgcctatattacgtcgaccgagctggtgcgcttgctgttcgggcagcttccgccgcaattttcccgattcttcaaatccttgctatactttacccatcatccgcgcattgcggaggcattgaagcgcgaaggcgtgtgttcggtcgaaaccgtccctacgctggaagccgcgctttcccattcttccatttccgtttcagacggcatggtctttcccggaacctcaaattaataaggagcaaaacggtgggcgaacctgaaaacaaatcatccgaacccgtacgcgagatacaggcatcaaaagaaatgccgtctgaaacctcttccccacgcaaagaaaacgaaacagaagtacacattcctgccgctccttttatcgtcaaacagtccggcagcaacgctttggcagtctgcgccctggtattggcggcattgggtttgggtacaagtggttttttgtttgtccaaggacagaatgtcttgaaaaaccaagagctggcattcaaccaaaaaatcgacaaagccgccttgggcgagtcggaaaacgccgccctgttgaaagacaacctcaaccggcaagccgccatacaatcagagctcgaccgtttggacggaaacgtcaaagcaaacggcgaacaaatcttggaaatgcaaaaatcctatcgcgagttgaccaaaggacgcgccgattggctggtggacgaaaccgagaccatactcaatctggcggcgcaacagctggtgttgactggcaatatccaaacggcagtcggcgtattggagcatatcgacagccgcctgtcccgtttcaatcaggcagagcttctgccgatcaagcaggcggtcagcagcgacttggcggaactgaaaaaccgtccctatgtcgatatttccggcacggcattgcgcctcgacaggctggaaaccgccgtatccggactgccgctgatgctcgacggcgtgctgaaaccgggcgtacaggtgaagaacgaagccgcttccgcttcatggtggcagaacgtatgggaaaaatccctcggcacattgaaggggctggtcgaaatccgacgtttggaaaacaacgatgccatgctgatttctcccgaacaggcatattttgtgcgtgaaaacctgcgcctccgccttttggatgcgcgcactgcattaatgcagcgcaacagcgaagtctatcagggcgatttgaacaatgccgaagccgccgtcagacagtatttcgatgccaagtctcccgccacgcagtcgtggctgaaagaactggcggaattgaaggcgttggatgtgcggatgactgcggatgacggtttgaaaaacagcctaaatgccgtccgcgcctatcgcgacggtacgcgcatgacggcggcggaaaatcaagaagcggaacaggcggcttccgaaccggcaaacgaaaaaacagcttccgaaccggctgccgcatcggatgtgaagaccatagaagcaccgtccctgccttcggaacgcaaaccggaacagcctgcaaaaaaacagaccgtaccggaaaaggcagggcgttcgccgtccgctaaaggagaacgcgcatgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctgattttgggaaatatctttatctgggagaatttgatggggtcttcagattcctttaaggaaaagaaagaaatatttgaaattggaacgcctgcttatcgccaaaagttaattgatgtttggaaaaagagcattaatggaaacgaaaaatcttgggtgctctttgaaaatgggacttgcgtcattttacttgaaccggaaaaagatttggcgaaacaagctaaagagatgttaagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccttccccgttttacaaacaaaccgaaagccccacatgatctctttgaaaaacgacactttcctccgcgccctgctcaaacaacctgtcgaatacacgccgatttggatgatgcgccaggcggggcgttatctgcccgaatacaaagccacacgcgcgaaagcgggcagcttcctcgatttgtgcaaaaacaccgaattggcgaccgaagttaccatccaacctttggaacgtttcgatttggacgcggcgattttgttttccgacatcctgaccgtccctgacgcaatgggcttgggactgtattttgccgaaggcgaaggcccgaaattcaaacgcgccctgcaacacgaggccgacatcgccaagctgcacgttcccgatatggaaaaactgcaatacgttttcgacgcggtaacttccatccgtaaagcattggacggccgcgtaccgctcatcggcttctccggcagtccgttcacgctcgcctgttatatggtcgaaggcggcggcagcaaagaattccgcaccatcaaaaccatgatgtactcgcgccccgatttgctgcacaaaatcctcgataccaacgcccaagccgttaccgcctacctcaacgcccaaatcgacgcgggcgcgcaggcggtgcagattttcgacacttggggcggcgtgttgagcgatgcggcgtttaaagaattcagcctcaaatacatccgccagatcgtcgccggactcaaacgcgaaagcgaaggccgccgcgtgcctgttatcgtatttgccaaaggcggcgggctgtggctggaaagtatggcccaaatcggcgcagacgcattgggcttggactggacgtgtaacatcggcgaagcacgccgccgcgtcggcaagcaagtcgccctgcaaggcaacttcgacccgttcgccctcttcggtacgccggaatccatccgcaccgaggtcgcacgtatcctagccgactacggacacggcagcggccatgtcttcaacctcggacacggcatcaaccaacacgccgaccccgaacacgccaaaatcttagtcgataccgtacacgagctgtctcggcagtatcacggcgggtaagccggcaggaaaccgcccgatatgccgtctgaagccgagagatggccggttagggtaaaaataaggcaatgcggcaatatccgccgtgtacggatagtacatgacggcggcgttgtcgtattggcgcaatcccaaccgtccctatgttcagacggcatttttgttttcagatgcagggaaaaccgatggcaaaaacgcttaaaaccctttaccaatgcaccgaatgcggcggcacttcgccgaaatggcagggcaaatgcccgcattgcggcgagtggaacacgcttcaggaaagccttgccgcgcccgagccgaaaaacgcccgtttccaatcttgggcggcggatacctcgaccgtccaatccctctccgccgttaccgccaccgaagtgccgcgcaatccgaccggtatgggcgaactcgaccgcgtattgggcggcggtttggtcgatggtgcggtcatcctgctcggcggcgaccccggcatcggcaaatccacgctgctgttgcaaaccatcgccaaaatggcgcaaagccgtaaagtgctatacgtttccggcgaagaatccgcccaacaagtcgccctgcgcgcgcagcgtttggaactgccgaccgacggcgtaaaccttcttgccgaaatccgcatggaagcgattcaggcggccttgaaacagcatcagcccgaagttgtcgtcatcgactctatccaaaccatgtattccgaccaaatcacgtccgcccccggctccgtgtcgcaggtgcgcgagtgtgccgcccaactgacgcgcatggcgaaacagatgggcatcgccatgatactggtcggacacgtgaccaaagacggcgcgattgccggcccgcgcgtgctggaacacatggttgataccgtgctgtatttcgagggcgaccaacattccaactaccgcatgatacgcgccatcaaaaaccgcttcggcgcggcaaacgaactgggcgtgttcgcgatgacggaaaacggtttgaaaggtgtgtccaacccgtccgccatcttcctcgccagctaccgcgacgatacgcccggctcgtgcgttttggttacacaggaaggcagccgcccgcttttggtcgaaattcaggcattggtcgatgacgcgcacggcttcacgcccaaacgcctcaccgtcggactggaacaaaaccgtcttgcgatgctgcttgccgtgttaaaccgccacggcggcatcgcctgtttcgatcaggatgtgttcctcaacgccgtcggcggcgtgaaaatcggcgaaccggcggcggatttggcggtcatcctcgcgatgctttccagcttccgcaaccgccctatgcctgaaaaaaccgtggttttcggcgaaatcggcttaagcggcgaagtccgccccgtcgcacgcgggcaagagcggctcaaagaagcggaaaaactcggcttcaaacgcgccatcgtccccaaagccaatatgccgcgcaacgccaaagagtttccgaacctgaaaatctacggcgtttcgagtttgcaggaagccatcgatatttgccgcgacagcagggaataaacggaaatgccgtctgaaatcgggtttcagacggcatttggtttgtggcggattgaaacaagaaggcataccggcgacagataagatttgcggcaaagttgcctgtgatgtggcaaaaacacacacgcccgtcatccccgcaagggtgggaatccggaatcgtccgtttcggcaatgattgaaaatcacggtaacccaaccgattggattcccgacttcgtgggaatgaggggcgtgtgcatttgatttccatccgccatatgtcggcgacgggcttattcgcctacggttttttgtatcagtttttcggcgtttgccaaagtgtttgccacttcgtcgaaaccgatgcggctgccggcgatgagggcgcgcgtatcggtataggcggcgcgtactttgccgtccgtttcggtaacgaggacgcgtaggggcagttgcagggcgaaggcggggtctttgaccatcagcggcgtgccggctttgggcgtgccgaagacgatgacttttgccggctgcatcgttaagccgtttcggcgggcggcttcctgatggtcgatgacggcaaaaatgtccatccctttgctttttatggcggtttcaaggcggctgacggtttcgtcaaaactgtattttgaggtgagggtatgcgtggtcatagcggtttcgttttgggtggacggttcgctggcaggatgtgccgaagcggttgaaatgcagagtgcggatgcggcaatcagggggagtatgtgtttcatcgtatttcctttttcctttttggttgaaacggtagaatcagactttattcgggaggggtgtaaccctttccaaatcagggcaacacatagggcggtgctttatgtgtcgtgaaacatcattgttccttatcggtttgtttatcaggcttcggacggggcggcgcgcgccgcgcccgatgttgcgccgcgtgccggaacgccgtatgccgtctgaaagcctgtcctttcagacggcattgcgtcatttcatcccttttttgagcaggtcttcataaccgccgtgattggcaacatttgtataacctgcttttttcagctcttgaagggcggcttcggcacgccgtccgctgcggcagtagaggttgaccggcgtgtctttgtcgggcgcggcttcgtgtatgcggcggacgatttggtcgacggggatgttgaccgcgttgtgcaaatgcccttcgctaaattcctgttcggaacggacatcgatccaaacggccggatgttgcgcggtttgggcggcggatacgggtttttgcggggctgcctgcgcggcaaaggcggctgaggcaatgagtgcggcggtaatcaggtgtttgatattcatagggttttcctgcggttgttgtccgaaaggacgggaagttattttatctgttccaaagcggcggcatctatgtcccaacgccaaacgccgccgcctttgccatccaatccgcgcaaaaacaggtagcggacggaaacggcggcgggcggttgtccgcgcagcttgaagtagcgtgcggcggcaacggcgtaaatcagtgcctgaaggtaatagtggtggtgtgcgacggcttcgtccattgcctgttgcgtgtaggcggatgcgtccgtaccgaggtggtttgatttgtagtcgatgacgcagatattgccgtcggggtcttggcagaccatatcgacaaagccgtttaaaaagccgttgacggtgtggaagtcgagcgtttcggcagcggcacggcagacttcgggcagcctgatgtcgtcgcgggcaaaccagtcgcgcaggcgtttgaggctgaagtcttcggtgtggagggtaaagcccatttcgggacagcggcactcgggtgagatgtcggacaggtcgtatgcccccgtcagcggcgttttgcggcaggcttccgccatttcggcaacggcgggcagccatatttcttcaaaaccgtattttttcagcttgtcggcaatgagggtttcctgtccggcggctgcttgtccgaatttgaaatcttcaagaatttcgtgcaggcacagccccgcctgcgtgcctttcggaaaatcgtgtatcgatatgccgtctgaagccgtcggcgtttcagacggcatcgccggcaccgaggtttcggcggcatccaaggacgggcaggcatcttcttcgccgccgtcgggcgtttgggtatggcggcttaaggcggtaaagctagtgtggcggacaaatcggaatccgcgttcgggaatgctgtttgcggcaaattcggcggtttgaccggcgttgctgcgataggcggcagggggcggcgcattttcggtgaaggcgaaatttgtgccggaaggggcgttgtccgccacgcgccgccagttgcgtttgagcatcgcgatgccgtctttttcacacgcataggcacggcggacggtttcacggctgtcttggggcgagccttcaatcaggtaggcgagggggttgtcggcagtattggtggagtacgcggcgtagatgttgagctgttcctcggcacgcgtcagcgcgacataaagcaggcgcaggcgttccgccatttcttcatcggcgtattgtttctgttcgtcttccgacagttgcgcctttgccaacagttcggttcggtttgcgccttggtggaggatttgccagtcggacggtccggtatcttgcgcgtcccacgcaaacgggcagtacaccagcggatactgcaaacctttcgaggcgtgcatggtaacgattttgaccaaatcttcgtcgctttccagacggatggcgcggttgtcgccgctgttgttttcggcaaggctgatttggtcgcccagccatttgtgcagcgcggcggggttgcggttttgcgcgtcttcggcggcaagcagttcgagcagttggaaataattggtcagactgcgcccgttgttccggcttaagaggcgcgtttcgatgccgtgtgtttgggaaaattgctgcatagcggcgaaaatgccgtatttattccagttgtcgagtgcggttcgggcagattccgcccaatgcaaaatctcgctttcgttttggttgaagtcgtgcaattgctgcgcgtcataaccgaatatgctgcttgtcaggacaaaacgcagcgttccggcgcggcgcggttcgagccagaagccgatgagtgcggacagggcggcggcttcgggcgaggcgaacacagattcgcgcgaaagcaggacgctttgcacctgccgttttttcagggcggcggaaaccatcaccgcctcgttgtgcgtgcgtaccagcacggcaatatcgcccgactgcaacgggcagcctttgaaattcagacggcctctggcggcttcgttgagcgcgtgggcgatttcgtcggcgcaatagtcggcggcacggcggcgcaaaacgtctttgttggctttttcattgtcgttttcgtgcagccaacgaacctgtacggcaggacgttcgggggacagcctgctttcggcacgcgccgcaccgacttccgaatagccgatgttttccaaaacgaacgggcgttctttgaggcggaacagcgcgcctatgctgccgataagcgcggcgtggctgcggtagttggtggcgagcgtgtagcggtgccgcgcgtcttccgccgcctgaaggtaggcgtaaatgtccgctccgcgaaagctgtaaatcgcctgtttgggatcgccgacgaggaacagcggtcggttttgggcgatgaaaatcttttggaagatttcgtattgcagcgggtcggtgtcttggaactcgtcgatcagcgcggtttcccagttttcggcaacggcgcgggcgagagtgtcggcgtgcggattgtcggtcagcgcggtgtggacatcgagcagcaggtcgtcgaaaccgcgttcgcggcgcgattttttcatctcggcaaggctgcggttgaggtattcgattaaatccagttgcagccggatcattgttgcttcttccgcttcttcgagtgcgttcaaatcgcgcccgaagtctgccagtttctgcaattcggcaaatactgccgcatcgggcgttttgccttttttcagtccggcttcgagtttgtcggatgcaagtttcaagagtctgtcgtgtgtgtctttgtccagaaagggcagttgtccggcggcggatttttgtgccagttctttaaaaaggttgccgaagctgtttttgcggtaactgttgccgttgaggtcgggatgaatgcgccaaaagccggcttccagttctggcagcaggcggcagatggtttgccatgaggtttcggcgttgcgctgcgcctgtttcaaatccgcctgcggacggcggaaattcaggtacgggcgggaaagatagcgcgaaatttgggcaaggacggtttgcggcacagctttgcgtttaagcgccaatgcggcaagcaccggatcattgctgacgcgttcccgccaaaaatcttgcgccgggataagcaggcggtcgccgtcttcttcggtcatttcgacatcgaacggtgcttggcacaggaaggcgtagtcgcgcaggatgcgctggcagaagccgtggatggtatagatggcggcgttgtcgaattgcccgatggcggccttgaggcggacaatcagacgcgtccggccctctttttgcaaagcctgttttaagagttcgggcaggaaggtgtcgccttcgtggtgttcggcgcagtaggcggcaatgccgtctgaaagcgtgtcgtctccaagtttggcaattcctttgctttctaaaacttgtaacacatcgtccaaacgcccgcgcaggcgtgttttcagctcggcggtggcggctttggtgaaggttacgaccaatacgcgttcgacgtttttttgttctaatacgatcaggcgtgtaaacagggcggcaatgccgtaggttttgccggtgccggcagaggcctcaatcaggttggtgccggaaatggggacggttagcgggtcgaatgcttggatgcttgcagacatagtgcgcgctcggaaaacggttggacggtaaaacgggaaaatgccgtctgaaaaatggtttcagacggcatcgtccggcttagaggttttgcaggcgttcgacagacggcgcgtagtagtatccgcccgaaacggcggcggagagatgtcggagcagcaggtcggttttgccgtccgtatcgccgaacatactcaataattgcgcttcgatattgtgcagcgtgcggcagtatgcggtaaacatcaaaccgtgttcgccgctgattttgccgaagggcaggctgcggcggacgattttcaggccgactccgttttctttcaggttgacgcggccgaggtgcgaatcgggcaggcggacatcgcggccgaattcgtcgtcggtttccttgccgcgtccgaccgaggcctcctgttcggcgacggggacggcatcccattttttcaaatcgtgcaggtatttttgcagcaggacatagctgccgcccgcatcgggttttccttcggggatgatggcgacttcgcggacattttcatcgccctgcgggttttccgtgccgtcgacgaaaccgtccagcccgcgatcctgatacaggcgcaaaccgtgttcttcggacgcgacgcatatgctgtcgccgaacgcgcccaaaacggattgggcaagcgcgtaggcggcgttttggcggaaggattggatgtggatggacatatcgtgctgcgtggacggcgcaagcccgttgcccatttcggagaagggtttgatttcactgccttcgtccgtatgtccgaatgttgcccaggctttgctgccgaaggcgatggtcagacccaaaatatcgtccggaaagcgggctttcaaggcagttaacgcgtcgagcgaagcgcggcaggcggctttaatatcgttgaggcgattggcggcgaagtcggcttcgataaagatgccggcttgggcgtggtcgggaatgatggcggattggggcgtgttcatgagatgttcctttttggtgtcatctgtttcggatagattatagcaccgaatcggcaggcggatttttgccggaacggcgtgcgtgaatccgccgtttacatacctgatgccgcttttcggtttcgtgccgcccgccgcctttcccgccccctttatttccgcttccggcggcttcggcatatcttttccattccgatttggaataaccatataaaaaaagtattctttgtgtttgccgcaatttcacttagaatgccgcacttgcacactttttacaggagaggatgatgttgaaaaaattcgtactcggcggtattgccgcattggttttggcggcctgcggcggttcggaaggcggcagcggagcatcttccgcgcctgcacaatcggcagtttccggttctttaatcgagcgcatcaacaataaaggcacggttaccgtcggcacggaaggcacttacgcaccgtttacctaccacgacaaggacggcaaactgaccggttacgatgtggaagtaacccgcgccgtggcggaaaaactgggcgtgaaagtcgagtttaaagaaacgcaatgggattcgatgatggcgggtttgaaggcggggcgtttcgacgtggtggcaaaccaagtcggtctgaccagccccgaacgccaagcgacattcgacaaatccgatccttacagctggagcggtgccgtattggttgtccgtaacgacagcaacatcaaatctatagccgacatcaaaggcgtgaaaaccgcacaatccctgaccagcaactacggcgaaaaagccaaagctgcaggcgcagatttggtggctgttgacggtttggcgcaatcgctgaccctgattgaacaaaaacgtgccgatgcaaccctgaacgacgaattggcggttttggactatctgaagaaaaacccgaatgcgggcgtgaaaatcgtttggtccgcacctgccgatgaaaaagtcggttccggcctgattgtcaacaagggcaatgacgaagccgtggcgaaattcagtacggcaatcaacgagctgaaagccgacggtacgctgaaaaaactgggcgaacaattcttcggaaaagacatcagtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatacgcttccgaaaccatacgcgcggcaattttgtccgtacctaaaggccaatgggaagcaggtttctccatcggcatgacctatatgcagacgttccgccgcattgtcgcgccgcaggcattccgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataaggagttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttgattaagcatttttcctgtgtttacagaggccagattagattcggattgctttcgatgacggctttgaattggttttgaatccgctcgatggcttcttgcgtatccgcctcaaaacgcaacaccagaatcggcgtggtattggaagcacgcatcagaccgaagccgtcgggaaattcaacgcgcagaccgtcgatggtgatgatttcggttgcgccttcaaattcggctttggcggcgagttcgtcgataacctgatggccgttgctgccttcgggcagggcgatgttgagttcgggcgtggaaatgctttgcggcaggttgtttaacacttcggacggattatcggaggcagacaggatttccaagaggcgtgcgccggcgtacagaccgtcgtcgaagccgaaccagcgttctttgaagaagatgtgtccgctcatttcgccggcaaccggcgcgccggtttctttcatggcggatttgataaagctgtggccggttttttccattatggctttgccgccgtgttctttaatccaaggcgcaagcaggcgggtggacttcacgtcgaaaatgactttcgcgccgggattgcggttcaaaacgtcttgggcgaacagcatcagttggcggtcgggataaataatgttgccgtctttggtaaccacacccaagcggtcggcatcgccgtcaaacgccaagccgatttcggcatcaccgtttttcagcgcggcaatcaaatcttgcaggtttttcggtttggatgggtcgggatggtggttggggaaagtgccgtccacgtcgcagaaaagctcggttactttgttgcccaagcctttgtagagtttgccggcaaacgcgccgcccacgccgttgcccgcgtcaatggcgatgttcatcgggcgtttgagcctgatgtgtccggtaatgtgtttgaggtattcgccggagatgtctttttcggtgacgctgccttgtttgccggcggcagcaaaaccgtctttttcaatgatggacaaaagttcttggatggcttcgccggcaagcgtgtcgccgccgagcatcattttaaagccgttgtaatcgggcggattgtggctgccggtaatcatcacgccgctgccgccgcattcgttgacggcggcgaagtagagcataggagtggcaaccataccgacattgaggacattgatgccgctgtcggtaaagccgcgccggatgtgttccatcagttcgggaccgctcaagcgtccgtcgcgtccgagcgcgatgcgggtaatgcctttttcggcggctttggcggcgatggctttgccgataaggtaggcggcttcgtcggtcagggttttgccgacaataccccggatgtcgtaggctttgaagatgtcgcgggcgatgcttgccataaggtttcctttgtgtccgtttaggaaaaacgggcatattttaacatagcggtatgccgtctgaaggcttgcgtccggttttcagacggcatagcacggttacatcaaataacatgccgtctgaaataaaagcagcctttgtgcaggctgctttcggattgtcggtttataccgcttcggctttaatgatgacgacaggttcgctcggtacgtcgtcgtggtaaccatgacgtttggtagaaacgccttcgatggcatcgacaacgtcaaaaccgtcaacgactttaccgaatacggcatagccccagtcttggacgacggttttgccgtacagctctttagaacggaagttcaggaaagcgttgtcggcagtgttgatgaagaattgcgcgctggcggaatgggggtcggaagtgcgtgccatggcgatggtgtatttatcgttgggcaggccgttggacgcttcgttttgaatcggatcgcgggtttctttttcgttcatgttttcatccatgccgccgccttgaatcatgaagcctttgatgacgcggtggaagattacgccgtcgtagaagccgtctttgacgtattgctcgaagtttttggcggtaacaggggctttgtcgaaatcgagttcgattttgatgtcgcctttgttggtgtgcaggataatcatgggtttcctttcgttagaatctggttttgaatgattcgacaaattgtgtctgaacgacaaacttcaaggtcgtctgaaaaatattctttcagacggtcttgttgtttaggtcgatggtttacatcagtacagcataagcccacagagcaaccaatactacgcagaggatgttcagcagtatgccgacattcatcatttcgcgttgcttgattaagcccgtgccgaacacaatcgcgttaggcggtgtggcaaccggcagcatgaaggcacaagatgcgccgatgccgatgacgaataccaagacttgttcgggcagccccatctgcatagcgatgccggagaaaatcggtacaagcaatgcggcggaggcggtgttgctggtgaactcggtcagaaaaataatgaaggcggcgacgatgagtatcaccaaaaatgcgggcgcgccggaaaaggtggcggcaacctgctgtcccaaggcttcggacgcgccggatgttttcaacagcgtgctcaggctgatgccgccgccgaagagcatcaacacgccccagtcggtattgcgggcgacttccttccattgcgccacgccgaagacgacgacggcgacggcggcactcagggcgataacggtgtcgggattggaaatgccgaaggcggttttgattttggagctgaatatccacgcggcggctgtggcaaggaaaatcaacagcgcgatcacgcggtgcagcgtccaagggatggattcggctttgatttccacgcgttcgttcaaattaggtttgaggatgacgtacagggagagcagcatcaagggcagaatcaacagcatcatcggcaggccgagcttcatccagccgacgaagtccagatttagggctttggcggcaatcaggttgggcggcgagccgacgagcgtgcccaagccgccgatgctggcgcaataggcgatgccgagcaggaggaagacgtaggttttgtgttctttttcctggtcgaggtggctcagcatacccattgctagaggcagcatcatcgcggcggtggcggtgttgctgatccacatggacagaaaggcggtaacgaggaacaacatcaaaaccgccactttcatattgccgcgcgacaggcgcaacaggctgacggcgattttacggtccagccgctgcatatgcagggcggtggcaagcgcgaagccgccgaaaaaaatgtagataatcgggttggaaaaatcagccatcgcctttttgatgtccatgtcggggaaaccgagtacgacggcgagaatcggcaccatcagtgcggttacggtaatgtggacggcctcggtaaaccaaagtgcggcaacgaaaatcagcagcgcgatacctttattggcatcggggctgtaaggcaggatgtggtaaatgccgaaacagacgacggcggaaataatggtggtcagcaggcccttaaagtcggtaatcggcttctgcgcactgagcagctcgacgttttcgggatgctgggttttgtcctttgcatgcaggttcatgaatactcctttaaggcaacaaaatcggtttttcttttgtgtcgtgcaatccgaaacggtttgtggaatcgccgcttctgcaactggttcgagtatatttgtaatctgatgtagtgtaaatatattgtaaacgatttgtcggttttgtttatgagatgggattgatatgtaaggggaaaaataggatatatcgggaagaggtgcatcctgtttggggaaaataaaccgatttagtccgggcggcaggcagctcgcgcggtaaagagggcaagggctgcgcccgtcaggtcggcaaggacatcgcccaaactgccggttctcgttgcggtaaaccatgcctgcgcgcattcgctgaagagggcgaaacagagggcaaagaccatcaggctgcgataggggatggggcggttgtcggttctgaatgctttggtcagaagccagatttgtgcgaaaaacagggcgaggtgcgccactttgtcaaaatgcggaaaaggcggtggcgcggtttcggcagctttgaaaagcagtgagtaaatgctgcctgcaaaccacaatgccgagagcaggataaagcggttgcgtggcagattcatgcttgttcctcttcaagccatgtctggcatagtttggataggcgcaggaattttccgccgcgtgcggccagcatatcgcgccaaacggcaatttcttcggcggagggggcatcgtctatgctgcattcgtagagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcttcttcccatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccgccgttgccgccgccgagtttgaatttgatccgtccgcagggaatgtcgagttcgtcgtggacgacgaggatttcttcgggtttgattttgtagaactgtgcaagcgcggcaactgcctgtccggaacggttcatgaacgtggcaggtttgagcagccaaacgtcgccgtcgggcagggcggcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgtcgaatgctgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttgacggctttgccgaaaatgcccaaaggcgcggaatgcaggtttaaatcttcaaatatgccgtccaaaccgctttgcagtgcggcggcgcggacggttgttccctcggcaagctgcatggttttcaaaacctgtcggtcgggcagcccgtacacaatctcaatttcaagcataacggcggtctgcctctttgacgaacgcttcgaccagcgtggtggaaaggtggttgaagacgggggaaattaaggcggacaaaacggcattggaaaaatcgtattccaaattgaattcgattttgcacatatcgtcgcccaaatcgataaatttccacgttccacgtaaggttttgaacggaccctcgagcagttccatacggatttccctgcccggaatgttgcggttgtgcgtggcaaacgattggcgaacgtgcatataatccataaacagccgcgccttcagttcgttgccgctacgcccgatgacttcggtcttgctgtaccacggcagaaagtgcggatagtcttcaaccttgtcgaccagctcgaacattttgtccgcgccgtgcagcaccaagatgtttttttcaacttttttcacgggcatcaccaatgcgggcgtgtattcgaagggcggtattatagcggtttaattttaaaccggtacagccttgccccgttctgatttcaatttaaaccgccatatcgcagattcgtaaaaaccgatacggctttggcgtttcagacggcattgagtggaaaatgccgtctgaaaacgggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatattgctcgtccaaaatccggcggatttccgcgtcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttgatgcgccggtggagatgcgtccgacgaagatgtcttcggcaatccgtccgccgaacaggatggagagctggctcaacatctgatctttatacatactgatgcggtcgcgctccggaagctgccaagtcagacccagcgcacgtccgcgcggcataatggttactttgtggacggggtcggtaaagggcaggctttcggcaacaatcgcgtgtccggattcgtgatacgccgtcgcacgtttttcgtcttcgtgcatcaccatactgcggcgttccggacccatatagattttgtctttggcgtcttcaaaatcgctctgatcgactttgactttattgcggcggccggcaaacagggcggcttcgttgaccaagttcgccaaatccgcgccggaaaaacccggcgtgccgcgcgcgagggacaataaatccacagattcgtccaaaggcacttttttagaatggacgttcaaaatctgttcgcgccctcggatgtccggcagggggacaaccacttggcggtcgaaacggccggggcgttgcagcgcaggatcgagtacgtcggggcggttggttgccgcaatcacaattacagtctgattgctctcaaaaccgtccatttcaaccaacaattggtttaatgtttgctcgcgctcatcattgccgccgcccaaacctgcgccgcgttggcggccgactgcgtcaatctcgtcgataaagatgatgcagggggcgtttttcttcgcctgctcgaacatatcgcggacgcggctcgcaccgacaccgacgaacatttcgacaaagtcggaacctgaaatgctgaagaacggcacgccggcttcgcctgcaatcgctttcgccaaaagcgtcttacccgtacccgggctgcccgccagcaggatgccgcgcggcacgcgcccgcccaggctttgatagcggttcggcgctttgaggtaatcgacgatttcctgtacttcttctttggcttcgtcgcagccggcgacatcggcaaaggtcactttgttggcatctttgtccagcaggcgggcgcggcttttaccgaatgagaatgcgccgccttttccgccgccgcccgtctgcatacgcatgaagtagaaccatgcgccaatcagcagcaggacgggcagcaggctgtaaaacagggcagccagcgcgctcggtttttcttccggcgttacttttacgcggacgtttttgtcgagcagtgttttaattaggttgtcgtccaaaggcgcgttggtgaagaaagtgcttttgtcggtgcgctcgcccttaatcaggtagccgctgacgacggatccttcgatgttgacgccggatacttcgccgttgttgacctgttggatgaactgagagtattcgatttgcccgttgtcttcttttttaccgtctaaagcgttgaacgcagccatcaggccgatacccaaggcgacccagacaaggattgatttaaaggtgttccccacttagcaaggctccataattgaggtgtaaaacggaaatgattgtaaagcacgccgtctgtattgtcagcgtttatttttgcccaataaataaatctcactggagcgattgcgcgaggcttcgggtttgcgcgtctgcaccgtgccgaaaatttcgcgcatggctgccatgtattcctgatagcctgcaccctgaaagactttgaccaaaaagctgccgccggttttcaggtgttgcgaggcgaagtctaaagccagttcgcacagataaaagctgcgtgcctgatcgcttacggcgtttcccgacatattgggcgccatatcgcaaattacaaggtcgagcgggcggttgtccaacaaggtttcgaattgtgccagtacgtcgttctcgcggaagtcgccctgaatgaaggagacgccccctatggcttccataggcaggatgtccaaggcgaaaactgctccggaagtacccgtcagcttggcggcaacctgcgaccagcttcccggcgcgctgcccaagtcggcaagtaccgtgccgggtttgattaatttgtctttttcgttgatttccaaaagtttgtatgcggcacgggcgcggtagccgtctttttgcgccatatggacgtagtggtcgttgacgtgttcgtgcagccacgcttttgaggatttggaacgtacagccatagtggttcgcgggtcggaatggaaaccgcgtattgtacgttaattttgccgatgtcgtgccaaatcgcgtacaatgccgcattattctttttattcaagcagtaggaaaatgacggataccaaattgaacaccaaagaaattttggaactgaaagcgcgcgcgcaccatctccatcctgttgtgatggtcggtcagcagggtctgacggacgcggtcatcaaggaaaccgatgcggcattgacggcgcatgagctgattaaagtgcgcgtattcggcgacgaccgtgccgaacgtatcgaaatctgcactgccttatgtgaggcggttgatgcgcaactggttcagcatatcggaaaacttttggtattgtggcgtaagaatatcgaagcctgacagcctgaagcagttgttttgctattgttctttaacgggcgggacgccgtccttcggcgcggcatttcggcgggccgaaaccctttccggtgaaaacggattttgattgccgcccgatgctgtctgcaagttgcggcggcttccgtatggtttgaattgttgacaggatgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggttcacggtcaggacgggctgacggacgaaaacggttatgtgatgaacgatgaaaccgtagaggttttggtcaagcaggctttgtgccacgctgaagcgggcgcgcaggtggttgccccttccgatatgatggacgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtaatggtcaagcccggtttgccgtatttggacgttgtccgccgcgtaaaggacgagttcggtgtgccgacttatgcctatcaggtttcgggagaatacgcgatgttgcaggcagcgattgccaacggctggctggacggcggcaaagtggttttggaaagcctgctggcattcaaacgtgcgggtgcggacgggattttgacctattacgctattgaggcggcaaagatgttgaagcgttgattttcggccgggttaattgaaatgccgtctgaaaccatggtttcagacggcatttttacagtttacaaagttgtatcgagtgcggcggaaatatcgttccaaatatcgtccgcgtcttcgatgccgatggagaaacgcagcagaccgactttgatgcccatttccattttcacatcatgcggtacgccgctgtgggactgggaatagcaatggttgaccaaactttccacaccgccgaggctggaagccattttgaccagtttcatgtttttaatcacgctgtttgccgcttcacgcgtgtcgtttttgagataaaccgtaaccacgccgccgatgcctttgggcatttgtgttttcgccagttcgtaatgttcgtgagacggcaggccgggatggaacactttttcaatggcaggatgggcttccaaacggcgcgcgatttcgagtgcgttttggcaatgggcgttcatgcgcagagccagtgttttgatgccgcgcaacaccagccagcagtccagcgggccggcaaccgcgccggtatgcaccatcatatcgtgcaaaggctgcgccagttctttggttttggcaacgacgatgcccatcaacacgtcggaatggccgcacaaatatttggtagcggaatggaatacaaaatcgcaacccatatccaacggctgttgcagatacggcgtggcaaaagtgttgtcgataccgaccagcgcaccggctgctttggcttttgcggcaaggactttgatgtctaccaagcgtaaaagtggattggacggcgtttccagccaaaccagtttgaccttgtgcgctttaagcagttcgtccaaattatccggattgcctaaatcggcaaaaacaacgttcaccccccatttttgataaacatcgaccaataaatcataagcgccgccgtaaatatcggcgacggcgacaatggtatcgcccgggcgcaggaaagtgcgccatacggcatcaattcccgccataccgctggaaaacgcaaaacctgccgcaccgtgttccaaatcggcaacggtgtcttctaaaatctgacgggtcgggttgctcaggcgcgaataacggtaaggcacattttcgccaatctcgtgcaacgcaaacatactgttttgataaatcggcggcatcagcgcgcggttgtgttcgtcgcaatcgtagctggaatgaatggctttcgtggcgaatttcatttggtctctgcctatgtagatgtgaataatcgaagattttatcactatctgaaaaatagaaacaatcaatgcagctgctaaaagcgagtgatataatctcgcatttgcagattgacggtatattccccggcggaaacgccataccatgcacacatctcaacaattacatgaatattaaggaaaaacaactcatgaacactattgcagacgtgcaatccagccgagatttgcgcaatctgccgatcaatcaggtcggtatcaaagacctgcgctttccgattaccctgcaaactgcagaaggcatccagtccaccattgcccgtctgaccatgacggtttacctgcctgctgagcagaaggggacgcatatgtcgcgttttgtcgcattgatggagcaacatgccgaagccttggattttgcacaattgcgcaagctgactaccgaaatggtcgcgcttttagattcccgcgccggcaaaatcagcgtttctttcccatttttccgcaagaaaaccgccccggtttccggtattcggtccttactggattatgatgtctgtctcacgggcgaaatcaaagacggggcatacggccacagtatgaaggtcatgattcccgtaacctcgctttgcccgtgttccaaagaaatttcccaatacggcgcgcacaaccagcgttcgcacgttaccgtcagcctgactgccgatgccgaagtcggtatcgaggaagtcatcgattatgtggaggcgcaggcgagctgccaactctacggcctgctcaaacgccccgatgaaaaatacgttaccgaaaaagcctacgaaaacccgaaattcgtggaagatatggtgcgcgatgtcgctacttcgctgattgccgacaaacgcatcaagagtttcgtcgtcgagagcgagaatttcgagtctatccacaaccattcggcttatgcctatatcgcctacccgtaggcgcgtttgcgatgaaccaaatgccgtctgaaaggcgtttgggcgttattggcgaatctgccgccgtatcggaaatcaatttgcaatacaagtaataaaaggatgcacgatgacagtattaagcaaagagcaggttctatccgcatttaaaaaccgtaaatcatgccggcattacgatgcggcacgcaaaatcagtgccgaggattttcagtttattttagaactcgggcgtttgtcgcccagttcggtcggttcggagccttggcagtttattgtggttcaaaaccctgaaatccgacaggcaatcaagccgttttcttggggtatggcggatgctttggataccgccagtcatttggtggtgtttttggcgaagaaaaatgcccgctccgacagcccgtttatgttggaaagcctcaaacggcgcggcgttaccgaaccggatgccgtagcaaaatctttggcaaggtatcaggcgtttcaagctgacgacatcaagattttggacgattctcgcgccttgtttgactggtgttgccgtcagacctatatcgcgttagccaacatgatgacgggtgcggcgatggcaggtatcgattcctgcccggtggaaggtttcaactatgccgagatggagcgcatattgtccgggcagtttggtttgttcgatgcggcagaatggggcgtgtccgtcgccgcgacattcggctaccgcgttcaggaaatcgccacgaaagcgcgtaggcccttggaagaaaccgttatttgggcataaggcaatgccgtctgaaaacgcaaggattttcagacggcattttttaatgcttggcggattcgcatttgaagtgcaactttccctaacagaaaaaggccagtatgcggtagcatacggcctttcctgcaagaaagattgccatgagccacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagcttatttaaaacgattcgccgggagcgagataacgccatttgccgggcggcagcctgccgagtttgaccttgcccatgcggatgcgtttcagcccgacgacgcgcagtccgaccagttcgcacatacggcggatttgccgctttttaccctgtttcaacacgaagcgcagttggtcttcgttttgccattctacttgggcgggacgcagtttctcgccgtccaaactcaatccgtgattcagtaaggcaagtcctttttcgtccaatttgccgcgcacgcgcaccaaatattctttttcactgccgctgttttcgccgataagctgcttggcgatacggccgtcctgagtcaataccagcaatccgaccgagtcgatgtccagcctgccggcgggggcgaggccgattttgtgtttcggatcgaaacggatgcggccggtatcgccttcccagtgattttcaggggtaatcagttcggcggcggatttatagcctttttccgcttgtgcgctgacatagccgacgggtttgttcaacaggatggtaatgcgtgccgcctgctgttcgtgggctttcttgttcagttcgatacggtctgccggtgaaactttctgaccgagtacggcggttttgccgttgaccgttacccaaccctgttcgatatagccgtcggcttcgcggcgtgaacaaagccccagttgcgccatgcgtttggagaggcgcacggcatcttctgtatggtcggaggaaattttgggattcatggatactttcgggtaaaggccggcttagactaattgctcgccccagtgcagtttttggcgcagggttttgaaatattggtagtcggtcgggtgcaaaatgcgtaagggatttcggtagcggcggatggtgatgcggtcgaggttttgcacgtcgatatgggtttgaccgtcgaaatggacgcgcgcgtcgccgccttgggtaacgaggatttcgatttcggacgtgtctggaatggcgatggggcggttggtcatggattgtgggcagatggggacgagcgtgaaggcgtgtaatcctgcctgcatgatggggccgccggcggcaagcgaataggcggtcgatccggtgggggtggagacaatcagcccgtccgaacgctgggtatagacgaattcccgattgacgaagacttcaaactcaatcatctgtccggcaccgccacgggagaggacggcatcgttgagggcgatggcgcgttcggcggttttgccttcgcggatgagtgcggcctcaatcaggatgcgctcttcggcaaggtatttcccttctaaaacgggcaatagcttgtccgtcatatattcgcggggaatttgggtcaggaagcccaaatgcccttggttgatgccgataatcggaacggcgcgcagggcgatttcgcgggcgacggagagaaaggtgccgtctccgcctaaaacggcgaccaggtcgcagtattgccccagttcggtcttgttgacgatatggcagccgacggtgtcttgggtatagatgcagccttcctttatgccgacttcgtcgagatagacggtaaagccgtgctgcttcaaaaaggtaatcagcgtgtgtgcggtgtcttggatgtcgggcgtgttggggcgggttacgatgccgatgttgtgaaaagggctgttcatgtcggatgccgtctgaaggttagtctatccaaatgtcgcgttcgagccggtcgaggcgttcgttgaggcgttccacgccgtcgcgcagtctgcttatttcgtcgaggcagtcggcaagggcttcgttgccgatgtttgcggactcggattcgcgggaaaatccgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgcctccttggaggattttctgtaccgcgctgttgcggaaggtaatttcggtgtctgcaaagccgtttcccgccgagagcaaaccgtcttccgtgatgcgtcccgccagtttcagcccggcaatgttcagggtcagtgttttgcctgcaaaggcggcaagttccgagcggctgtccgggctttgcagaatcaggcggttgatgatggggaggagggcggacatattttctgatcggggcggagaatgcctgtttgttgctgttgccgcttattttacaggcttaagccgttatcgcaaacggtacggatgattttgcccacgctgtcgtcgggtgcaaaatccggcgcgggcaagccgagtttggcggcttcttccgtatagaattcgcgtcgtgtcgggtggcgcggttcgataatgtttttcagccgcctgccgccggggttaaatgccgtctgaaacaggctttcgacggcgatattacggtggacgatgttgatggggcggttgccgcccgggatgttttgcttttgaacaaggcggccgacgggatggcgttcggcgcaataaagcccgcccagccgcaggatgtcgatgttcggaacgccgctgtcgagcaggtgttgttcggcggcgaggatttggcgggcggactcggtttgcggatcgggtagggcgatttcgtcgcattcgcgcgctgtatcgccgtaaacgctggtactgcttgtgaaaatcaggtgttgcacgttgcacgcccgggcaagttctgcccattgtttgacggtatcggcgtaatgtgtcagcgatgatggcggcaagaggcagaaccaaacgggtttgttggcatggtgccgccaaaagcttgtatctcgggcaaggttcgcgctttgaaacgcgctgtcttgattgaggtcgatggtatcgaggtgtatgggcagattgatatcgtccgaagtcaggctgcgtttgacggcggcaacgcggctgccgtgttggtaaaacttttgtgccagcggcaggccgaggtaacctaggcctgtgatggagatatggggcggggggactgcgcgcattcgctgataccgtcgggtaagtgccgtctgaaggctgattcggacgctgtgggtttacgggttgccgttgccgattttccggtcgtatttcttgcggtgttcgggcaaaagataaggacgaaggaggcttaaggtgcggcggatgccgcgtgctttggagtcttcggtcagcttggtgcggccgcgcagggagctgtcgaagtcgaaccagtatttcgtgaccatccacatattgacggcgagatcgttcatggcggtttggtcggcttggatgatgttcagaccgttgagttgggtgagcaggttgaccaagagcggggagactttggcttgggtgaaggtattgtgttcgcccaacaattcggcactgcgtgcaagcagggtgttcacgtcgctgaataggaagcggtattcccacatcacatcataaataccggccatataattgatggagtcttccacatcagacggcaacacggcttcattcaggtatgccagcagggcttcgctgtaacgtttgaacagttggacgatgatttcgtctttgttgcggaagtggtaatagaggttgcccggactgatgcccaagtgggcggcaatatggttggtgctgatgttgcgctcgccttcctcgttgaaaagcgcaaggctggcgtcgatgatgcgtgtgtaagtattgattttggcggggcgggtcacgggcatactccttggatttacaggctgaacgaagcaggcagccaattaggttcggcgtgcaattctacctgaaaccgagcaaatactgtaaatttgatgtgttgcgccaactgccggacatcgtttgccgaggcgttgtttttgttcactaagaccaaagcctgcctgtcatgtaccgccgcgccgccgatttggaagcctttcagacggcattggtcgatcagccagccggcggcgagtttgaccgaaccgtcgggctgcggatagcgcggcatatcaggatgccgctgcaacaaggtggcggctttttctgcgctgacgacggggtttttaaagaaactgccgacattgccaagcacgttaggattaggaagtttactgttgcggattgcacacactgcatcggaaacatctttcgccgtcgggaccctgcccgcgctcagttcggcaacggcggccgccaaatcgccgtaacccaaagtcggcacaaaatgcgtttttaatgcaaatacgaccgaaacaatcacataacgccctttaccctcctgcttgaacaggctttcgcggtaggcgaagcggcagtcggcattggcaagctcgacaaaggtctccgtatccaaatcaaagcagcgcacgctgtgaatcacgtctttcgcctccacgccgtatgcgccgatgttctgcacgggcgatgcgccgaccgtacccggaatcaggctcaggttttccaaaccgctcaaacccagcgcaacggtgtgcaggacaaaatcgtgccaaatttcgcccgcctgcgcttcaatcagaaccatgccgtctgaacgcgcaatctcgcgtatgcctttgttttccatgtgtacgaccagtccggcgtaatcctgcatcaaaaggatgttgctgccgccgcccagccataaaacagtatcgcggtcgaactccagcagtcggacgatgtcgcgcaactcgtcggcatgttcgagcgcgataaaggcccgggcttgggcgcgaagaccgaaggtgttgtagggggtaaggtcggttcggtatcggatgggttgcatggtttgaactttaactgtatttgaattgaagtgtactgcgttttcagacggccttatgcgatctgaccatctccctactgcacaattccaagcaccacaccaaggcgatggcggcgatggtgagcgaggcaatcaatgccgtccagaagccgtaaatgcccatattgaaacggtaggcgagcagatagcccggcagcaggccgcagccccaaaaggcggcggcgtggatgaacatcggcacctttgtaactttgtagccgcgcaaggcgtaggaggcgatacattgggtgaagtctgccggttggaacaagccggcgaacagtaagacggtggcggcgatgcttaaaaccgccggatcattgttgtacatacttaccagcggcgaacggaataataccaaggaaagcacggtaatcacggcgagcatccatcctaacaccagtgacacgcccgaaatataacgcgcccgcgaaaattcgcgccgcccaagcgaaaagccgatgcgcaccgtccccgccgagccgacgctttgcggaatcatatagagaatccccgacaaactgatgccgacctgctgcgccgccacataatcctcgccgaaaggcgcaatcaaaaacacgataaacgaaaacgcgctggcttccaaaaaataagacagcccgatgggtgcgccgattttccaaatctgtttgaacaccgcccaatccggtttgccgaatttcgccgtcagtccgaatgggcggaagaaattttccttggcgatataaatccacaatgccagcgcgctgaaccaaaacaccgccatcgtcgccagtccgcagcctgcgccgcccaaagcgggcataccgaatttgccgtaaacgaaaatatagttcagcggcacgttcaacacaaacgccgcaaagctgaccaacataatcaggcgcgggcggttcaggctggaagtgtaggcgtgcagcgcgcggtgtaccattgccgccggcatcgccaagctggtgaacaacatatactgcgccatcgtgccttccacataatcgctcaaggtcagccagttgcggaacggcgtaatcgccgcccacatcaagaccatgccgaacacgcccaaaaacagcccgaaccaaatcccctgccgccccgtttcgcccacttcgtcggttttacccgcgccgtaaagctgggcaatcatcgggttcagcgccgccataatgcccataaaggtaatataaaccgtggcaaacgcgctgctgcccaaagccaccgccgccaagtcttccttgcccgcaccgcccgccatcacagtatcgacaaaaccgatgcccacctgcgcgacctgcgccaacagcatgggcagggcaagagtggtcagcaggcggacttctttcaggaagacgggaaaggaaaagcggttgaggtcgagcagcataagtgttcaatcaacaaaaatgccgtctgaagcagaaaacggcagcaggaagtgatgagaaataatggtgcacattatatcgtaaaaaaatgccgtgccgtcagacggcggatacagggtataaaagtatattcagattgtgtgtattttatggtaaagtttggttttaacgacttgacggcattgagccgtcggacaggggctgttcggattctgaatcggaaagaagcaccgccgttttgacagcggcgtgatgcgttgcggcaaagatgccgtctgattgcggatcgggcagtcttttgtgtttacaggataaaatagaaggcagattctcatgcagacatggcagcttccggaacatatcgccgacgtactgcccacgaacgcgcggcagcttgaaagcgcgagggagcagttgttggcactgttccgcgtacacggttatgaactggtacagcctccgctgatggagtacgcacattccctgctgacgcatatcgatgcggggctttccctgaaaaccattttggtaacggacaggctcagcggcaggcagttgggcatacgcgccgacatcacgccgcaggtggcgcgtatcgatgcccatcttttatccgccaaccaagggattaaccggttgtgttatgccggtccggtgttgcacgcgcagcccgacggtctgctgaatatgcgcgaacccttgcaggcaggggcagaaatgtacggttttgctgacatccgtggcgacatcgagctgatagacctgatgctgaaaagcatgaaaattgccgatatgggcaaagtgctgctttcgctggggcatatcggcatatttcgcgccttgtccgatgcggcacatttggatgcggggcagtccgcaacgctgcttgccttgatgcaggataaagataccggggcggtcgaagcgcaggtcaaggcttggaagctggacggcatgtgggcaaaagcattctcgctgttgccgcgcctgtacggcgggcgtgaagtgttgtccgacgcgcgcggacggttgccggatttgtcggcggtcggcggcgcgttgggcgaattgcaggcggtgtgcgacgcattccccgattgtgaaatccatatcgacttgtccgagctgcgtgtcgacaattaccacacgggcttgctgtatgccgcctatgccgccgatttccacgacgcggtcgcgcgcggcgggcgttatgacggattgggcggatatttcggtagggcgcgcccggcaacgggattcagtttcgacttgcgcagctttatcgggcgtttgcccgccatcgaacggcagcccgccgtgttggtcgatgcggaagatgccgaagcggcgcacgaagcggtcgaagccttgcgtgaacaagggcagtgtgtcgtaatcgattacggtatcggacacaatgtttcggaagagcttgcaggccgtctgaaaaagacggacggcgtttggcaggtcgtgaaacgctaaatacccgttcatggcggatgaaaggcaaatcgtggcggggcgcaaagccgcaccggtttggggatttccgcaataatttttaatatcgataggttatatggctatggctaaaaatgttgtagtaatcggcgcacagtggggcgacgagggtaaaggtaaaatcgttgactggctggcggaagaagccggcggcgtggtgcgcttccaaggcggccacaatgcgggccataccttggttgtcggcggcaaaaaaaccattttgcgcctgattccgagcggcatcctgcatgaaagtttggactgcttcatcggttcgggcgttgtcgtctcccccgaagccctgttgggcgaaatcgacgagttgaacgcggcaggcgtgaaaaacgtcgaaggccgtctgaaaatcgcgccgacctgcccgctgatcctgccttaccacatcgcgctcgaccaagcccgcgaagcatcgcgcggcaaaggcaaaatcggcacgaccggccgcggcatcggccctgcctacgaagacaaagtggcacgccgcgccattcgcgccgccgatttgctgcatcctgaaaaactgcgtgaaaaactggatgccgtccttgcctattacaatgtccaactgcaacatctgcacaatgccgagccggttaaagcggaagacgtgatggcggttatcgaaaaagtcgcgccgcgcattgcgccgatgattaccgacgtgtcccgcgtgttgaacgagaaaaacaaaaacggcgaaaaactgctgtttgaaggcgcgcaaggtgcgttgttggacatcgactacggcacttatcccttcgttacctcgtccaactgtctggcgggcgcagcttcggcaggcgcgggcgtaggtcctcaaatgctggattatgttttgggcatcgtcaaagcctataccacgcgcgtcggttcgggcccgttcccgaccgaattgttcgacgaagtaggcgtaggtttggcagaacgcggacacgaattcggttcggtaaccggacgcgcacgccgctgcggctggtttgatgccgccgccctgaaacgctccatccaaatcaacggcatttccggtatgtgtattactaaactcgatgtaatggacggcgttgaaaccatcaatatctgcgtcggctatgaattgcccgacggcggcaaaaccgacatcctgccttgcggttccgatgcggtggaaacctgcaagccgatttacgaaaccatgcccggctggcgcgaatccactttcggcgtgaaggactacggcgcattgcccgaaaacgccaaagcatatttgaaacggattgaagaagtctgcggcgcgccggtcgccatcgtctccaccggccccgaccgagaagaaacgattgtgctgcatcatccgttcgcataaggttttgcagtaaaattgccgtctgaagccctaatccgccgttggtcataaatagtagggtatcaacatttcgggctacaatggtacgtcagccaatgccaagacgtgccagcctgatttgttgatgtgtgtactattgcataggcggttaagccatgcaggagatgaaagtgtatatgtcgcgcaaagcccattagccgcaagcgaggggcggggtgcgcgagagagaggggggcaggtgctaagtcattggttatctccttactatctatctaactacgggtgcattatgcgcctatgcctgttttttgtcaaacactatacagttaaaatgtgtaaatatttagtaaggacatatacccttttctttacatttagctccatcggataccagtgcgttcagagaaaatttgaaaatttctatattttggttgtataatgctttcattttagaaaggtctataatgccaaaatcactctcgctacaagatgttcagttaaggttttccagtaaatttcctgataagacggttttgaagttcactaaaaactacgaaccggtaacaatccaatgccctttgcatgggtcggttgtttacgggaatctacaagctgccatgaaatcctcaacaggatgtcctgaatgtactcgaaatcccgaaaagccctctccaaacgccgttgccattaggttggaggacacagagacaggggaaatctacgagtttgcaagtacactggctgccagtaaatttatcggttgctccaacagcactttagctgtacgtttaagcggacgcactccgtttgaccgattgattaggtatcgttataggttggtaaagtaagttcacaaccactatggcacttacatttactcaagcagtttctaagctaacctctaaatttccacatttgaatcttgtggagttcaatggcgttcgttacccgacggtaatcgtctgtcctatacacgggagggttacttgctctacattcaaaagtatgttggactctaaaagtgggtgtccaaaatgtgcatcttatggtgtcaattcccacaaaattccagaagatacaatagataaattatctaaaaatacagtattggaggatactgtaactggcgaaacacttacattcccctcaagagcatctgctgcaaggtcattgggtataaacccagcagctatcactgaccgtataaaaggtcgggttcacacagagactttacttgcagggaggtataaggttcacatctgcactaaatgacgtatacactttttaacagtgtatacccctcgccactatcaggtgcttctcgaaaaatttgacatttttataaatttgctattaaatccatttgacaatcaattttggagtctcaaatggccaaatctttcaaccaagcagcttctgaacttactgatatattccctaatatctctctaaccggctttgacggtgtgaattacccagtaaccgttaattgtcctatgcacgggaacgttcgttattcgacatttaatgcccttataaagtcaaagtacgggtgtcctgagtgtgctaagatgtcaaaaacccaaacacctccaaatgtagggaagcccctcctcatcctcgacacaacgaccaacgaaacactcacgttcccaagcgttactgccgcaggtgctgctttaggtgtacatttccaacaaatcaatcacaggctcaagggtcgaacgtcgcccgacaaccttatttcaaacaggtacaaagtgcttgggtacgataggtaaggttcacaacaccctaaatcctacgaaccaagctcgacggacgttcaaatcccggttagagttaatttatgtaaagatttagtaaagacgtataccatttttctttacattgtgcttgcgcaggatttcaggtaggtctcaaaaaatttgaaaatttctatattttggttgtgtaatccatttgcacataacctatggagacaaattatgggtaagcgaatgactttcgataccgccaaatcacgctttcaagagaaatttccacatttagaattgttggagttcagtggcatttataaaccttccagtgttagatgtcctacgcacggggttgtccaacttttgtattacgacacagctataaagtcaaagtatgggtgtccggagtgcgggaaacttaaaatgaaggaaaatacgcctccccaaaaccaaaaacctgtctccatcctcgacaccgccacaggcgaaacactcacgttccccagcgtacaagctgccgccaaagccctaaacaccccctacggctctatacgaaccaagctcgacggacgttcaaatcccgacaaccttgtctgtaacaggtataaggttctgctataatcaacctatggaaaatattgaagaatacgcactgctgtctcccgaagccctgctggaacgcctggataccgttttgagtatcagaatcggcggcaagggttgggaatccagttatgaccgccaactttgcacagacgctggtcgaaatacaggacagtctgtacagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaacaaaaatcaggacaaggcgacgaagccgcagacagtataaatagtacggaaccgattcacttggtgcttcagcaccttagagaatcgttttctttgagctaaggcgaggcaacgccgtactggtttttgttaatccactatattttctgtccggatacggtttatcagggtatatcaatgcggcgtatccggtgcggaaatggatacggttggtgtcggtatggaaacctgatgttttcagacagcatatacaaaaaaccgtactgcttgcgcgtacggtttttgccgtttcaaatcggtttaaagcgatttgaggcgggcgatacggttgtccagcgaagggtgggtgctgagcagggagtcgcgcgtatctccggcgatgcccattgcgttcatttcttcgggcaaatcgaccgggttgcctttgagcctttgcagggcggaaatcattttcggcgcgccgaccagttttgccgcgcccgcatcggcgcggtattcgcgttgtcggctgaaccacatgacaattaagctggcaaggaagccgaacaggatttggaataccatgctgaccaggaaataagttccctgggactggctgccgtcgttgtttcgggcaatcaggttggcaataatgcgcgacaggaacacgacaaaggtattgaccacgccttgaatcagcgtcagcgtaaccatatcgccgttgccgacgtgtgccatttcgtgcgccaatacggcttccacttcgtcacgcgtcatatggtcgagcaaaccggtgctgacggcgatcagggagctgtttctcgatgcgcccgtggcaaaggcattgggttcgggggagtggtagatggcgacttcgggcgttttcaggttccattgccgcgcttgggcttcgacagtgttcaaaagccaggcttcttcttcggtgcgcggcgtgtcgataacttccgcgccgaccgattgtttggcgataaatttggacatcagcagcgaaataatcgaaccagtgaagccgacgacggcggaatacgccaacaggctgcccgtgccgccccggctgttgatgcccaaaaccgccaaaacaatgttgattacgaccaaaacagcgatattggtagccaaaaacagaaaaattcgtttcacggatgttcctttttggtagggtgtgatgttttgaaattttgggggattgtcccaaaaagttgccggcttgtgaatatcagactcggcaaaggtatgcaaaacatttgcttgcaaatggcagtttgtgcagttggtttttgaactattgtgccaagccgtgtagaatcgtaaaccatctgtttgattccaataaacacatttcaaaggatcacttcatgaaagcattacttttaggcgcgccgggcgcgggcaaaggcactcaggcgcaattcatcaccgcagcgttcggcattccgcaaatctctaccggcgacatgctccgtgccgcgattaaggcaggcacgcccttgggtttggaagcgaaaaaaatcattgacgaaggcggcttggtgcgcgacgacatcattatcggcatggtcaaagaacgcatcgcgcaagacgactgcaaaaacggtttcttgtttgacggtttcccgcgcacattggcacaagccgaagcgatggttgaagcaggcgtggatttggatgcagtcgttgaaatcgatgtgcctgacagcgtgattgtcgaccgcatgagcggccgccgcgtgcatttggcttccggccgtacttaccacgttacctacaacccgcccaaagttgaaggcaaagacgacgtaaccggcgaagatttgattcagcgcgacgacgacaaagaagaaaccgtgaaaaaacgccttgccgtttaccacgagcaaaccgaagttttggtcgatttttacagcaaactggaaggcgaacacgcgcctaaatacatcaaagttgacggcacccaagcagtagaagccgtgaaagccgaagtattgggcgcattgggcaaataaatcgaaaaggtcgtacccacgggcaggcttcgcactctgaaaacagaaaatcaggttttcagacgacctgtttttgataaacagcgtgttgcaaccgaaaaataatcatttggcgtcattcccgcgcaggcgggaatccatttctgaatttgggcaatcgctgtttaaatctgatgaactgagttttatcaatggattcccgcctgcgcgggaatgacggctgatgtaccggttcaaatttatccgaaacagtttgtcggaggcttgagtccgcgtaggtcggacatcaatgcccgacctacggtttgaatttacgttgttatagtggattaacaaaaatcaggacaaggcgacgaagccgcaggcagtacagatagtacggaaccgattcactttgtgcttcagcaccttagagaagcgttctctttgaactaaggcgagacaacgccgtaccggtttaaagttaatccactatactgcgaaaaagacgataaaggtcgtctgaaaacccgaaacgaaaacaccatgaatcctttaatctccgacttccaaactccgcaacaacgcacccccgttatcgtcgcccttgatttttccaacgaaaaagacacgctcggattcgtccgcaaccttgacccgacattgtgtcaaatcaaaatcggcaaagagctgtttaccgcgacgggacgcaatttggcagaaagcttaatcaatcaaggtttcaaacttttcctcgatttgaaataccacgatattccccacaccgtcgcgcaagcctgcaaagtcgctgccgatatgggcgtttggatggtcgatatgcacgcatcgggcggccgccgtatgatggaagccgcagcagaagccgttgccggatacggcacgaagccgctcttaatcggcgtaaccgtgttgaccagcatggaacaaagtgatttggcggaaatcggtttgaacaccgcccctgaagaacaagtcatccgcttggcaaaactggcgcaaagttcgggcttggacggcgtggtctgttccgcccaagaagccgcgccgctgcgccgcgaattgggacaggattttgtcttggtcacgcccggcatccgcttggacgttgccggcaataatgatgaccagcgccgcatcatgacaccggccgaagccttggctgccggttcgacttatttggtaatgggtcgtcctgtaacccaagctgccgatccggtagccgtattgcgcgaagtgaaccgcgtggcaaaccttgaagcaaactgattttcagacggccttacaggctgaggccgtctgaaaaaatacaacggaggcaatatgtccgccaagttccaacaagaaaccctcaaatcccgtttcgcgcaagccaaagtcctggttgtcggcgacgtgatgctcgaccgctattggttcggcgatgtgtcccgtatttcgcccgaagcccccgtgccggtggcgaaaatcggacgaatcgaccaacgcgcgggcggagcggcaaatgtcgcgcgcaacatcgcttcgttgggcggcagggcagggctgttgtccgtaaccggcaacgacgaagccgccgacgcgctcgatgcgctgatggtgcaggacggcgtcgcctcctatctgatgcgcgacaaacaaatcgccaccaccgtcaaactgcgcgtcgtcgcccgcaaccagcagcttatccgtcttgattttgaagaacatcccaactgcgaagtgttggaacaaatcaagcagaaataccgcgaaatcttgcccgaatacgacgcaatcattttttcagactacggcaaaggcggcctgtcgcatatctccgatatgatcgattgggcgaaacacgccggcaaaaccgtcttaatcgaccccaaaggcgacgattacgaaaaatatgtcggtgcaactctgattacgcctaaccgcgccgaattgaaagaagtggtcggcagttggaaaaacgaaagcgagctgaccgaaaaagcgcaaaacctgcgccgccacctcgacctgaccgccgttttactgacccgaagcgaagaaggcatgaccttgttcagcgaaggcgaaccgatttaccagcccacccgcgcccaagaagtttacgacgtatccggtgcgggcgacaccgtcattgccggaatgggcttgggtttggcggcaggctgcaccatgcccgaagccatgtaccttgccaatactgcggccggggttgtcgtggcgaaactcggtacggcggtttgctcgtttgccgaattgatcaaggcattgtcagggcaatcaacaatgtagttttcatattgataagataaacagaacgatataagtatgactatttcgacaatggcacagacacacgatactcgattacaaaaaactttgctctttcccagtcaacaaggttggaaatctaaaacttttcttaaacctgattcacatattagattagcaaccgtattcagcgggattggtgcggttgaacaggcattccaccgattaaatttaaaccataccattgttttttcaggagatattgatccatacgttaaaaaaagttatcttggaaactataaattaaatgaagatttttggcataacgacattactcaatttgatgcgagaaagtttagaaatcaagttgatattttagttggaggcagtccttgccaagcattttccatggttggcaaacgtgcaggattagaagatacacgaggaacattattctatgaatttgctcgcgttgtggatgaagtccaaccaaagatatttatttatgaaaatgtaaagggcttgcttaatcatgataatggaaaaacttggaaagttgtaaaaagtgttttttattcacttggttatgacttatatttccaaataatgaatagtaaggattatgggattcctcaacatcgtgagcgtatttttgttgttggctttcatacccctcctataaatggttttcagtttcctgaaaagattgaattagaacatactatgcaagattttttggaggactatactgatagcaaatattttttacgtgaaaagggtgcgaaatttgttaccagttctaaaaatagacaaaaacgttatacacagattaatggagaaattgccttatgccaaaaagcaaatcaacaatttaattggcatggtgattttatttttcaggcagcccgcgaatctgaatttgatgactttatttttgatgtaaataacgttgaggaaaaatattatctttctgaaaaaatcaaaaattatgttttggcaggaggaacaaaaaattttaaaaccagtacggaaactgatttgcctgtagctcgcccattattgcaaactatgcataaaatgcatcgtgccggggttgataattatgttactcataatcgtggacgtattcgtaaattaacacctagggaatgtttgcggctaatgggttttagagatgattttaaaattttagttagtgatactcaaatgtatcgccaagcgggaaacagtattgttgttgatgtattaatcgctatattaaaacaaatggatattacgctttatggagagtaaaatgccggattttcaaagaattactattgaaaacatagagtattttattgtcgatagtattcaaaatttacgtgcggaagatagttttattcacaggaataacaagttatctgtttttggtggtaatggggaagcacgcaaatatgtaggtagttatattgatgatagtggtcgaaaactaagtacattttttgagtatgaaaattgggggattactgagacaaaaaatggaaggagggtagaatatcctttcattcagaaaaattgttttttttataagaaaaatttacagcgttatttggttgatgcaaaagttgaatatcacaaacaagaacagaaatatcatcatgatatttcaaggttttatgatgattacgttttaagtattaataatctgcctacagaaaatattttcttttcaatccatgatgtatcagaccatttggaaaattctaaaggttaccgtaggggttatatccgttcggaggatgatatatggtcaatttggcgtaagattgtattgcccaaaattagttatttatcaattcttaaactattgcctgtcaaagatatagaagattcagaaccattattttatttccgaatatttttggattatcaatttcgctctatcgtgcacccgcaactcttatcaagagaaaaattagaaataccggcttcagaatttaatcaattcgtagagcaagaaatcattaaacagaaaagtagaaaagggcagcagaaatatcgcaaggatgttataaatcatatgtcgcaatgtccatttacattaattacagatgagattttgttaagggctagtcatattaaaccttatatggtttgtattactgagaaaaatgagaaagaggcattagattatttaaatgggttagctttaacgccgacttatgattggttgttcgatcaaggttatattactttcttggatgatggtcgtttgatttgcggtactcgactaagccgttacacatgggaaaaacttaatatcaatccaaatgcaaaaaattaagatgagaatatatcccgaaggaagagaaaaatatttggaatatcatcgcaaatttgtgtttcaggacaatatcgatgatttcttgtaactaagtttattaattttactcaaaacaaaggaaaccgaatatgaccatcatcgtaacaggcgcggccggctttatcggcagcaacatcgtcaaagcacttaatcaacgcggtattactgacattgttgccgtcgataatttgagcaaaggcgaaaaattcaaaaaccttgccgagtgcgaaatcgcccattatctcgacaaacacgaattcatccgccaagtgagggaacacattttaccttatcaaaacatcgaagccgttttccatcaaggcgcgtgttccgatacgatgaaccacgacggtttgtatatgatggacaacaactaccagtacacgctggatttgctggactggtgtcaggacgaacgcatccccttcctttatgcctccagtgcggcggtttacggcaaaggagaaatcttccgcgaagagcgcgaactcgaaaaaccgctcaacgtgtacggctactccaaattcctgttcgaccaagtattgcgtcgccgcatgaaagaaggtctcaccgcccaagtcgtcggcttccgctacttcaatgtttacggacaacacgaacaacacaaaggccgcatggcatccgtcgccttccaccacttccaccaataccgcgaacacggttacgtcaacctgttcggcagtaacgacggctacggcaacggcgaacaaacccgcgacttcgtcagcgtcgaagacgttgccaaagtcaacctctacttcttcgaccatcccgaactttccggcatctacaacctcggtaccggccgcagccaacagttcaacgaactcgccgccgccaccgtcaacgcatgccgcgccgccgaaggcaaacctgaaatgagcttgaaagagttggtagaagaagaacttatccgctacattcccttccccgacgcgctcaaaggcaaataccaaagcttcacccaagccgacatcaccaaattgcgcgaagccggatataaggaagaatttttcgatgtcaaatcaggcgtcgaccgctacgtcaaatggatgctggaaaatttggcttaatttgaatgcccgtaaaaaaatcgtctgaaaatatcaggcgattttgatttgtttaacttttatatggatttcgatgatgaccgaaatgcaacaacgcgcccaactgcaccgccaaatttggaaaattgccgacgaagtacgcggcgcggtggatggctgggactttaaacaatacgttctcggcacacttttctaccgctttatcagcgaaaacttcaccgactatatgcaggcaggcgacagcagtattgattacgccgctatgccggacagcatcatcacgcccgaaatcaaagacgatgccgtcaaagttaaaggctatttcatctaccccggccagcttttttgcaatattgccgccgaagcccatcaaaacgaagagctcaacaccaagctgaaagaaatttttaccgcgattgaaagctccgcctccggctatccgtccgaacaggacatcaaaggcctgtttgacgacttcgacaccaccagcagccggctcggcagcactgttgccgacaagaacaaacgccttgccgccgtcctcaaaggcgtggcggaactcgatttcggcaattttgaaaaccaccacatcgaccttttcggcgatgcctacgaatacctgatttccaactacgctgccaacgcaggcaaatccggcggcgaatttttcaccccgcaaagcgtatccaagctgattgcgcggctggcggtgcacggacaggagaaagtcaacaaaatctacgacccagcttgcggctcgggcagtctgctcttgcaggcgaaaaaacagtttgacgagcacatcatcgaagaaggcttcttcgggcaggaaatcaaccacaccacctacaacctcgcccgcatgaacatgttcctgcacaacgtcaattacaaccaattccacatcgaattgggcgacacactgaccaacccaaagctcaaagacagcaaaccctttgatgccatcgtttccaatccgccttattccatcaactggataggcagcgacgaccccaccttaatcaacgacgaccgctttgcccccgcaggcgtacttgccccgaaatccaaagccgattttgccttcatcctgcacgcactgaactacctttccggcagaggccgcgccgccatcgtctcattccccggcattttctatcgcggcggcgcagaacagaaaatccgccaatatctggtggagggcaactacgtggaaaccgtgattgcccttgcgcccaatctcttttacggcaccggcatcgccgtcaatatcctggttttgtccaaacacaaagacaataccgacatccaattcatcgacgcaagcggcttctttaaaaaagaaaccaacaacaacgtcttaatcgaagaacacattgctgaaatcgtcaaactcttcgccgataaagccgatgtgccgcatatcgcccaaaacgctgcccagcaaaccgtcaaagacaacggctacaacctcgccgtcagcagctatgtcgaagccgaagacacacgcgaaattatcgacatcaaacagctcaacgccgaaatcggcgaaaccgtcgccaaaatcgaacggctgcggcgtgaaattgacgaagtgattgcagagattgaagcatgagcatcatcctatacaccgccaacgacggcactgcccaatttgccttgcaggaatttggcggacagctttggctgacgcaggcggacatggcagaactgtaccaaaccaccaaacaaaatatcagcaaacacattaaaaccattcttgcagagcaagaattggaagagaaggcaactgtcaacttccagttgacagttcaaaatgaaaacgggcgcaaggtaaaccgcaaaatcgcccattattccctgcccatgattattgccgtcggctaccgcgtccgttccgcgcggggcatccaattccgccaatgggcaaccgaacggctggacgaatatctgaccaaaggctttgccatagacgacgaacgcctgaaaggcacaggcggcggcgactattggaaagaactgctcaaccgcattcgcgacatccgcagcagcgaaaaagccctataccggcaagtgcttgatttatatgccaccagccaagactacaaccccaaaagcagcgaaagccaaaccttttttgccgccgttcaaaacaaactgcactatgccgccagccggcaaaccgcagctgagctgatatacagccgtgccgacagcagcaaagactttatggggctgaccacctttcaaggcgcaatccccacgctgaatgaagccaaaatcgccaaaaactatctgaccgaagacgaactgttccgcctgaaccgtctggtttccgccttcttcgacctagcggaaatcaaagcgcaggagcaaagccccatgtatatgcgcgactggatagccgaattggacaaattttccgggctgtacggacaaggcacattacagggtgcaggcagcatcagccgcaaacaggcagagcagaaagccgaacgcgaataccgcgcctatgaagcgcgcatcctgtcgccggtggagcaagcctatctggaaagcgttaaagcgttggaaaaaacagccgtgcaacagatcaaacagaaaaaagaccgcacaaaataactaccattcaggctacctgaaaaagcagcctgcacaccattgcaggcagcctgaaagcaggacggacttcagcccgcagaaataacggcaaacggacagagtgagccgaagcaccccgcaactgccccacatcccgccgcaacgggaaagaaacggaaaacaaccatggatatgcaaaacaaagcgaaaaaattgattgagatgattcagacggcaccggtggagtggaagccgttgggggaagtggcgaaagtattaagaggaaaacgtttgacaaagaaagagctaattgaaggtgggaaatatccggtttttcatggcggattgattcctcttggttggtttgaccagtttaatcgtagagctaatcaaacgatgattattaatacgggaagtattggtgaagttatatggagtggcgtagatttctggtcatctgatggtacttttgtgattcaaacaccaaactatcttgatgataagtttatattctactttttaaaaacaagagaaggatatataaaatcccaaaagagagttggtggagttcctactattgatagattagtagttgaaaatatttcgatccccatcccacccctggaaacccaacaaaaaattgtaaaaatacttgacaaattcacagagctgtaagctacgctggaagctacgctggaagcggaattaaccctgcgcaaacgccaataccggtattaccgcgactttcttttagattttaacaatcaaatcgggggggatagctgatggctataaaggccgtctgaaagatgtggtttggaagacgttgggggaggtatttaatatttttgctggaggcgacgtaccaaaagacgctttctctgaagtggaaacggaagaattttgtatccccattttatctaatggtataggaagtaaggcactatatggctggactaatgttgctaaaatcaatcaacctagcttaactatatcagctagaggaactataggttgggctagctttcagaataaaccttttttcccaatagtacgcctgttagtgttaacaccaaaaattgaattaaacctaaaatatgcctactactttatgaaaagtattgaatcaaattataaagttcctgaaagcggtattccacagctaacgaaaccaatgataaaagatatttcaatccccatccctccactccccgaacaggaaaaaatcgtcgccatcctcgacaaattcgacaccctgacccactccatcagcgagggcctaccgtacgaaattgccctgcgccggaaacaatacgaatattaccgcgggcagttgttgagcttcccaaaggctgcctgaaaagtcatagctggtctttaaatcatgccgtctgaaaaatattgataaggaaatatcatgggaaaaagtttaaccgaaattgctgaggaactaaaaggaaacgataaaaaagtccagctaatctatgcttttaacggaacagggaaaacacgtttgtccagagagtttaagaatttaattgctccaaccagttcagaagagccagacggagagccaacaagaagaaaatttctctactataatgcatttactgaggatttattcttttgggacaatgatttgttagcgaacgaagctccaagattaaaaattcaaaagaatagttttaccgactggttgcttagggataatggactggatggagctgttattaaaaactttcaatattatacagatgataagttgactcctgattttaatgatgatttttcagaaattgcattttattttgctcgtggtaatgatgagcagattgaaaatatcaaaatttccaaaggtgaagaaagtaattttatttggagcattttctatgtattaatcagacaagtcatcgctgaattgaatattccagaagatagcgaagaaggacgttccacagatcagtttgacgatttggaatatatttttattgatgaccctgtcagctctttggatgaaaatcatctgattcagcaagcggttgatttggctgatttgataaagcttagcaaaccgaggttaaagtttatcattactacacataatgttttattttacaacgttctatacaatgaactaaaaaaattagaaaaggaaaagaaaagttatcttctgttaaaaaatgaagatggtagttttgatattcttgaaaaacaaggtgattccaataaaagtttttcatatcaccttcacttaaaaggagttattgaaaaagctatcgagaatcagcaggtagaacggtttcattttatgttgctgagaaacctgtatgaaaaaacagctaattttttaggctataagcaaaggtctgatattttgcccgaagacagcagacgaaactattttcaacgtattattaactttacaagtcattctacattatctaatgaggcatttgccgagccaacaccacaagaacaagaaactgtcaaattgcttttgcaacacttgctggataactataatttttttcaagatgatgaacaaagagataagccatgaacctcgaaaccaaacccatcgctgaaacgccgaatttcatcgtgctcgaccaatatgaaaaaatcgaacagtcgggcagctaccaatcggaaaaccggttggaagcggagttaatcgccgatttgcagaatcagggttacgaataccgcaaggatttgaacagccaaagcaggctgctggaaaacctgcgcgcgcagttgcagcggctgaacgatgtggcgttttcagacggcgaatgggcgcggtttttgacggaatatctggacaggccgtctgaaaacattaccgataaaacccgcaaaatccacgacgaccatatttacgatttcgcttttgatgacggtccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggtcgtatgctaccgcatactggcctttttctgttagggaaagttgcacttcaaatgcgaatccgccgtcgtctgaaaaacatttatctgctggacaagaaaaaccttgcccgcaaccatgtgcaggttatcaaccagtttgagcagacgggcacgcatgcaaaccgctatgacgttaccgtgttggtaaacggcctgccgctggtgcagattgaattgaaaaagcgcggtgtggcggtgcgcgaggcattcaatcaggtgcaccgttacagcaaagagagcttcaacagcgaaaattcgctgttcaaattcctgcaaatcttcgtgatttccaacggcacggacacgcgctatttcgccaacaccaccaagcgcgacaaaaacagcttcgatttcacgatgaattgggcgcggtcggacaatcatccgattaaggatttgaaagactttaccgccacgttcctgcagaaaagcgtattgctgggcgttttgctgcattacagcgtgttcgatgcgaatgatacgctgctgattatgcggccgtatcagattgccgccgccgaacgcattttgtggaaaatcaacagctcggcgcaggcgaagaattggagcaaaccggaaagcggcggctatgtctggcacaccacgggcagcggcaaaacgctgaccagctttaaggcggcgcgtctggcgacggaatcggcatttatcgacaaggttttcttcgtggtggacaggaaggatttggactatcagacgatgaaggaataccaacgtttttcgcccgacagcgtgaacggttcggaaagcacggcaggcttgaaacgcaatttggaaaaagacgacaacaaaatcatcgttaccaccatccaaaagctgaacaacctgatgaagggcgaagataatctgccggtttaccatcagcgagttgtctttattttcgacgaatgccaccgctcgcaattcggcgaagcgcaaaaaaacctgaaaaagaaatttaaaaaattctgccagttcggctttaccggcacgccgatttttcccgaaaacgctttgggcgcggaaaccacggcgggcgtgttcgggcgggagctgcattcttatgtgattaccgatgccatccgcgatgaaaaagtattgaaattcaaagtggattacaacgacgtgcgcccgcagttcaaagccgtggaagcggaacaggacgagaagaaactgagtgccgccgaaaaccacaaagccctgctgcaccctgaacgcatccgcgaaatcacgcaatatatcctgaatcagttcaggcagaaaacgcaccggctgaatgcgggtggcaaaggctttaacgcgatgtttgccgtcagcagcgtggatgcggcgaagtgctattacgaagcgttcaaaacacaacaggcaggcagcttgcacccgctgaaagtggccaccattttttcctttgcggccaacgaagagcaaaacgccgtcggtgaaattgtcgatgagacttttgaaccggaagcgatggacagcagcgcaaaagaatttttgcaggctgccatcaacgattacaacgcctgtttcaaaaccaatttcggcacggacagcaaagcctttcaaaactactaccgagatttggcaaaacgggtgaaaaatcaggaaatagatttgctgattgtggtcggcatgtttttgacgggttttgacgcgccgacgctgaacacgttgttcgtcgataaaaacctgcgctatcacggcctgatgcaggcgttttcgcgcaccaaccgcatttacgatgccaccaaaaccttcggcaatattgtctgcttccgcgatttggagcaggcaaccattgatgcgattaccttgtttggcgacaaaaacaccaaaaacgtggtgctggaaaaaagttacgaagaatacatgaacggctataccgacagccagaccggcgaagcacggcgcggttatctggatgtggcaaaagaattgcgcgagcgtttccccgatcccgacaaaatcgaaacggaaaaagacaaaaaagattttgccaaactcttcggcgaatacctgcgggcggaaaacgtattgcagaactacgatgaatttgccgcgctgcgcgagttgcagagtgtggacgcggcggacgaagatgcgatgaaggcgtttcaagaaaaatactacctgagcgatgaagacgtgcaggaaatgcggcaagtgccgatgccgtctgaaagggcggtgcaggactaccgttccgcctacaatgacatccgcgactggctgcgccgccaaaaagcaggcgaacagaaagagcaatcaaaaatcgactgggacgatgtggtttttgaggtggatttgctcaaatcacaggaaatcaatctggattacatcctgcaactggttttcgaacaccacaaaaaaatcaaaggcaaagcggagctggtggaagaaatccgccgcatcatccgcgccagcatcggccaccgcgccaaagagggtctgattgtggatttcatcaacgatacggatttggacaaagtacccgacgttcccgccatactggaaaccttctacacctacgcgcaagaggtgatgcggcacgaagcggcaggattgattgccgccgaaggcctgaacgaaaccgccgccaaacgctatttaatcagctcgctcaaacgcggctatgccagcgaaaacggcacggaactgaccgaaaccctgccgaaaatgagtccgctcaacccgcaatatctgacgaagaaacaaagtgtttttcaaaagattgcggcgtttgtggagaagtttgccggaatagggaccgatatttgacaaaatgccgtctgaaatttcagacggcatttttgattttatgcggaggcggtttttattttgaccttgcttttcttaaacttcaacacggcttcttcttttgccgcatcccagtctatccgtacgaagccgccgtcggatagtttgccgaacaggagttcgtcggcgagcggtttgcggattttttcctgaatcaggcggtgcatcgggcgcgcgcccatttgcgggtcaaaacctttttccgccagatatttgtgcaatgccgacgtgaattcggcttcgacttttttgtcgaggagccggtgttcgagctggagcaggaatttgtccacgactttggtgatgacgggttcggataagggcgcaaacgggataatcgcatccaagcggttgcggaactcgggcgtgaagagcttgttgatagcctgcatttcgtcgccgcgctcgcgtttggcggtaaagccgaggctgggtcggctgagactctccgcacctgcgttagtggtcataattaggatgacgttgcggaaatcggcactcttgccgttgttgtcggtcagtttgcctgcgtccatgacttgcaggaggacgttgaaaatgtcggggtgggctttttcgatttcgtccaagagcaatacgcaatgcggctgtttgttgatggcttcggtcaaaaggccgccttgttcaaagccgacgtagcccggtggtgcgccgatgaggcgcgatacggcgtggcgttccatatattcggacatatcaaagcgttgcagcggtacgcccatcgagtaggcaagctgtttggcgacttcggttttgccgacgccagtcggaccggagaagaggaaactgcctatcggtttgtcgggcagggcaaggccggaacgcgacattttgacggcagcaaccaacgcgtcgatggcgttttcctgaccgtaaaccatgtttttcaaatcgcggccgaggaattgcagcacctgtttgtcgtcgtgcgacacggttttttctggaatccgcgcgactttggcgatgacggtttcgatttgcgctttgccgatgacttttttctgtttggatttgggcagaatccgttgctccgcgcctgcttcgtccatcacgtcgatggctttgtcgggcaggaaacgctcgttgatgtagcgtgcggagagttcggcggcggcttcgagtgcgccttgagtgtagcggacttggtggaaggcttcaaacatcggtttcaagccgcgcaggatttgaacggtttcggaaacggtgggttcgaccacgtcgattttttggaagcggcggcttaaggcatggtctttgtcgaaaatggtgcggtattcgtcgtaggtggtcgcgccgatgcagcgcagcgaaccttttgccagcgcgggtttgagcaggttggacgcgtccatggtgccgccgctggtgctgcccgcgccgatgatggtgtggatttcgtcgataaacaaaatggcgtgcgggattttttcgagctgtttcaagacggatttgacccgcgcttcaaagtcgccgcggtatttcgtgcccgccaacagcgagcccatatccagcgcgtacacttcggcatctttaagcgcgtctggaatgccgccgttgacgatttgatgtgccaaaccttccgccagcgcggttttgcccacgcccgcttcgccgaccaaaagcggattgtttttgcggcggcggcataggatttgcaccagccgttccatttcgtgtttgcgaccaatcaaagggtcgatacggccggctttgacttcggcgttgaggttgacggtgtacgccgataaagggtttttgcccggtttggtgcggtttccattatcgtcgtccatgccgtctgaagaatagttgccatcgtcttcatcttcatcttcatcttcatcttcatcgggagagccgtgggcaatacagcgcaaaacttcaaaacgcgtaaccgattgcagcttgaggaaatagacggtgtggctgtcggtttcgctcatcagcgcgaccaaaacgtccaacggttcgactgcggcttttccggcagactgggtatgcaccatcgcccgttgcatcacgcgttggaagccgagcgtgggccgggtttcgaccgtgtctaaaaggtgttcgggaatcaggggggtgttttcggcaacgctggcggcgagctgttcggacaccactttcaaatccgcgccgcagagcttgaggacgttgtggacggaggcatcttcttcgatgagtaccaaaagcagatgctcgaggctgataaattcataatgagccttacgcgcctcgcggtaaagctgctgcaaaatctgttccaattcgggtgcaagcatattaaatctcctcgacaatacattgcagcggatgcccttcggcttttgcccgctgcatgacttgttgttgtttggtttgggcaatatcgcgcgtgtaagtgccgcacaggcctttgccttcgtgatgaaccaagagcattaccgctaccgcctgttcttgtccgagcataaagatttcggtcaggatttcgacgacaaattccatcgtggtgtaatcgtcgttcaataggaaaacgccgtaacgtttcggcggcagggtgttcagacggtgcaagagcgtgtcggattggtgttgcgcggtcatagtgtgtcccatttgaaagccgcgttcagacggcatttttgttgtattttcggtacttttgcctattttcccacttttttgaaaacatagcttgacgttttgtcttaacaaatgtaaaaagacggttaagcaggattgggcatccgccgagtatatcaagctggaaggaacgccagacggctcggtttgccgtatgccttgttttgctgattttgttaatttttgagtataggaagtttctaatggcaaccggtatcgtaaaatggtttaacgacgctaaaggttttggtttcatcacgcctgatgaaggcggcgaagatttgttcgctcacttctcagcaatcaatatggaaggtttcaaaaccctgaaagaaggccaacgcgtctctttcgacgtaaccaccggccctaaaggcaaacaggccgccaacattcaggctgcttaattcctgatgtacggtcaaatgtatatttgaaaacggcgggacaggcaatgtcccgccgtttttgtctgccgttttgccggcggcggaaaaaccccaatccccgcacgccttatcctgaacttgtgtgtaccctgttgtggacaagtggcttagtattttgacggataagggaaaatcagtgctgatgaaaaaatgtgcaatgttgtcggcaaaaggcggtgcggcataaaacggcaaacgggtaggcacggggcaaaacgtgctgccttcgtcttcagacggcatcggcagggcgttcagcttccggcaaccgtcatccccgcaatcagaatcgagccgattttgttggacgaacgccgcaaagcgtcatccgccacgccgacaatgtcgcggtacatatcctgcaagcgtccggctacggtaatctcgtggacggggtaggcaatcacgccgttttccacccaaaaacccgccgcgccgcgcgagtagtcaccggtaatggtgttcgcgccctgtcccatcagttcggttaccaacaatcccgtccccatttctttcagcaggtcggattgcgtttcgtgcgtatggttcaaatacaggttgtgcgcgccgccggcgttgcccgtggtctgcataccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttcgatttcgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaaccgtttcgggcggcaggggcaaaagcgcgccgtttgcagggcggacggtgcaaaatgccgtctgaacgcggcggcattctgttaaaatgcgctattggaaaaattcgagaatcaagatgtttgaacaagaagacgaatggatcagcaaaacccaaatgaaaaagcagatgaacgatttgcaggatttgggtatggcgttgaccaagctctcaaacgatacgctgaaaaaaatcggtttggatgcggatttgtacgaggcggtaaccgcctataaaaaaatcacatccaacggcgcgctcaaacgccaggcacaatttatcggcaggctgatgcgcgataccgatcccgcgcccatcgaggcgtttcttgccaagctgcgcggcgacgatgcggcgcacaacgcctttttgcaacgcgtggaacaggcgcgcgtacggctgttggcagacgacggcgcgttgacgcagtttatgtcggattttccgcatgcggacgcgggcaagctgaggacactcatccgcaataccaaaaaagagcaggagcaaaacaaaccaccaaaaaatttccgcgccctgtttcaagagttgaaaaccgtgatggaaaacggggacgcggaaatttaggcatattttcagacgacatccgccgttatttagattggaggataaaatgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatgaacagcaatgccgtctgaaaagctttcagacggcattttaagcacacacgcacagtaaaaccccacgttatgtcagtcaaaatccaaacccgatccgtcaataccgacgtttttaatcatttgctcaccgccggtgccgatcctttaatcgcccagctttgtgcttcgcgcggtgtgcaaagtcctgccgaattggacgacaaactcgcttccctcctgccttatcaatcgttgacgaattgcgaagccgccgcccgccgtttggcggatgcggttgggcgcaaggaaaaaatcctgattgttgccgactatgatgccgacggtgcgacggcgtgtgccgtcggtatgagcggtttggcggcgatgggggcgaaagtggatttccttgtgcccaaccgctttgaacacggctacggcttaacgcccgaacttgccgaaatcgctgccgcgcagggcgtggatttgctgattacggtggataacggtatcgccagcatcgcaggcgtggcgagggcgcaggctctgggtttggatgtcatcgttactgaccaccacttgccggccgagaccgtgcccgactgcatcatcgtcaatccgaaccaaaaaggctgcggttttccaagcaaaagcttggcgggcgtgggcgtgattttttatgtattgatggcgttgcgtgccgaattgcgccgccgcaattatttttcagacggcatcaaagagccgaatttgggcgaacttttggatttggtcgcactcggcacggttgccgatgtcgtccctctcgaccacaacaaccgcatcctcgtgtcgcaaggtttgaaacggatgcgctccggcaaaatgcgccccggtatccgcgccttgtttgaagtggcgcggcgcgattggcgcaaggcgcagccgtttgatatgggttttgcgttgggcccgcgcatcaacgccgccggacggctggacgatatgtcggtcggcatcgcctgcctgttggcgcgagatgattccgaagctcaggaactggcggctcagttaaacaacctcaatatcgagcgccgcgaaatcgagcagtctatgctgcaagacgcactgaatgatttccccgaaaccctgccttcaggtcagatgactttggtggcgtatcgcgacgacttccatcaaggtgtggtcggcattgtcgccagccgcctcaaagaccgtttttatcgtccgaccatcgtgtttgcgcctgccgacaacggcgaagtacgcggttcgggacgttccattcccaatttgcacctgcgcgatgctttggacttggtgtccaaacgccatcccgatttgattttgaaattcggcggacacgcgatggcggcgggtttgagcatacttgaacacaacattcccgcgtttcagacgacctttgaagaagccgtgcgcgaaatggtgtgcgaagacgatttgtcgcaaaccttcatcaccgacggcagcctgcccgcctgcgacatcacgttggaacaggcgcaaaaccttgcccgtcacgtttgggggcagggcttcgcgccgccgagctttaccgacgagttccacgtcgtccgccagcaacctttgggcgcggagggcaaacacaaaaaagtctggctgcaaaaagacggctgcgaatttgaagcgatgttttggcgttgcagcgaagacattcccgaatacatccgcacggtttaccgccccgttgccaacgaatggcgcaacaatctcgaattgcagctgtatatcgattactgggaagccgcgtagaggcggcggaacactgtttgaatgtgatttctgttccttcatttgcctgtttgtacgacgggaatgttcccaatcggagaaggcgcatcaaatttcagactctgccacaaaagcagggtctgatttttttggagggcaatctgttataatgacgcgttgccgccgcgagggcggcgtgattcggacggcgtagtttctacgccttttgtttatggttacggcatcttgcaaaccgcgcctgatgccgtctgaacacggttgcctgtggagatgccgctcttcgggtcagaatatttatgctgaaaaaatggttgaataagatgctgccttccggtcggagcagtaaaaaagcggaaagtaaaacggtcattcctgccgaaagacacaacatccgtgccgaaatgttgagctttgccgccgaaaacgtcatacgccgcctgaaagggacggggtttcaggcttatgtggtcggcggcgcggtcagggacctgctgctcggcatcgaacccaaagatttcgatgtcgcaaccgatgccacgcccgaacaggtgcacaaactcttccgccgcagccgcatcatcggcaggcgttttcagattgtccatgtgatgaacggtgcagagactatcgaagtaacgacgtttcgcggcggtgcgaaagtacatcagaatgcacgcggcaggattatgaaagacaatacctatggcagcatcgaagaagatgcgatgcggcgcgattttacctgcaatgccttgtattacgatcctgaaaaagaagagattttggatttccacaacgggattgccgatgttgccgcccacaggctggttatgattggcgatgccgccgaacgctatcaggaagaccctgtcaggattttgcgcgccatccgcctgtcgggcaaattgggctttgagctgtcggaagaaaccgccgcaccgattgccgaatcgatatgccgtctgaagcacgaaccggtagcgaggctgttcgacgaaattatgaaattgctgttttcagggcacgctcgcgagtgtctaaaacgtttgaacggatttgacataccggacgacatccatctgctgctcaatgccttgcgcgtttcagacggcatcgccggaaaaatgacggtgcttgccctgaaaaataccgatgagcggctgcgtgccgacaaatcggtttcggtcggttttgtattggcggctctgatgtggcccgagttggaacgccattggaaaagcaatctgcaacagggtttgaaacccgcgcccgccctgtccgatgcaatcaatacgatgcgcgaaaccgtcgaacgcggttggggcgtgccgcaacgcttttccgccacgatgcgcgaaatttggatgttccagccgcagtttgaaaaccgcaaaggcgcaaggccgcacaaactgtttgcacaggcgcgtttccgtgccgcctatgatttcctgctcttgcgcgccgaaaccggcaatgcggaccgcgcccttgccgagtggtggacggcgtttcagacggcatcgacggaacagcggtcggagatgaccaaaaacgaagccgccgcccgacacgaaaaaaacgaaggacaggcgaaaaaacgccgccgtcgcaggcgcaaacccaagccgaaggttgtgggaacggattgggaataagggtcaacagacatggagcaatgaagtttcaacacatgggatgaagcataaagtgccgttctatgcattatcctgatttgtaaggggattcatccccgtaaataaagtctaaccctgcctctcggaaaaaggatgtccgggtgggcagggttcaagcaacaaggaaaaattgatgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggatacggagcttggcttccgtatctgtttttctctgcctgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacgaaggtagggatcgactttctgggtcaggtctccgggcaggaagcccagtttctcgccggcttcgacggctgggcgcactaaaatgatgcgttcgacttggtgtttttccatcgcatcgacggcggcggcaacggcgagataggttttgcccgtacctgccggcccgagaccgaatacgatgtcgtggttgagcagggcgcggatatagccgttttgccgtggcgttctgccgccgatgctgccgcgcttggtgcggaaataataggcgtggtcatggtttttttcttgatgaccggcatcttcggtttgggcttcgacggcggcaagcctgatgtcgccgtcgtttaggtcgcgcgtctgcgccgtttccaagagtttgagcagtgcgcgtttgccggcgtgtgcaaatgcgccgttgaaagtgaaatgttcaaaacggcggctgatgtggatatcgagtgctttggcaagtaaatcaaggttgttgtcaaaagaaccgcacagacgctgcaacgccaagttgtcggtttcttctaaatgcaggtggacggtatgtgtcatatgaaggtccgaatagttggatattgtgtgattttaatctatagtggattagatttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttcaccggtattttcttaccgtattctgcgattgcctgtcggaaaatgccgatcaacctgcctataacggcattttcgccaaattcgttcagacagttttctctaagtcgggcaggttcgaaatcagagtggtgttcacacattttgatgagtgcgtcggcaagggcatcgtcgtcgtcaacaggaaccaaatatccgttgccgtctgaaacaatagattccgcaccgccgcagcgtgttgcaatgacgggcaatccttgggacagtgcttcgatatagactacgccgaaggtttctgtgcggctggcaaggacgaatgcgtcgctgttcctcatcaaatccaagactgcttcgggctgcaatgcgcccaaaaatgtaacggcatgggtaatgcccaagtctgccgcctgctgtttcagccgctgttcttcctgtccgctgccgccgatgttcaggcgcagttgcgggcattgtgccaacgcccgggcaaaggcagtgagtaggacatcgtgtcctttgagacggcgaaggtgcgagacggtgcagaacacgaaatgcggtttgttgttttttttctctttgttcaaacggtcggttgaatattccgcccagtatgttgggggaggtactgccattcgcagccgtatttgtgttgcaggacgtgtgcgaaatggcggctgacggcgagacgtgcggcggcgtgtgccgccgcatttttcataggctgccattggtgcgggcgcaccaaaccgcgcgtaatggtgctgctgtgttccgtgacgacataggggatgccgtatttttgggaaatcttgaaggcaagtatgccggcatagttcatacagtgggcgtgaatcaggtcgggcagcccgttttcgcggatgtagtgtttgaaagctttcaaacccgcacacacccagcggatgcggtcgatgtcgatgaacggaaagcgggggaagaaatacatgccgtgccatgcatagatgtccaaaccgctttgccgatatagtggattaacaaaaatcaggacaaggcgacgaagccgcagacagtacagatagtacggcaaggcgaggcaacgctgtactggtttaaatttaatccactatattttgcaaaaccgtaagggtcggtcaggatgcttgctgtttctttccgcaagtagcggaacatcggtgcaagcacggcggttttgatgcctttcctctgcaatgccagtgcctgattttgaaaaaaatcccgtccacatcctgttcggattgcggataccatgaggggatgacgaggacgtgcaagggttcgggcatagtgggattccgtatcggaaaggcggttattataagacagacgcagaccgaatatttaaattgttgccttacgctaatgcaatttggcgcgccggtgtgttagattggcagttttatcggtaaggaggcggatatgttgcgtcttgttttggcggcttcgctgtcggcggtatcttttccggcagcggctgaagcattgaattacaatattgtcgaattttccgaatcggcgggtgtcgaggtggctcaggatacaatgtccgcacgtttccaagtgacggcggaaggacgggacaaaaatgccgtcaatgctgagtttgttaaaaaattcaacaagttcatcagaaaatcgaaaaatggtagctttaaaaccgaattggtatcgcgcagtgcgatgccgcgctatcaatataccaacggcagacgcattcaaacaggctgggaggagcgtgcggaatttaaggtcgaaggtagagattttgatgagttaaaccgttttattgccgatattcaagcagatgccgcgttggaatatacggatttccatgtgtcgcgcgaacgccgcaacgaggtcatcgatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctgatttgaggtgaacggcaaatgccgtctgaaacccgacgataagggttcagacggcatttatatttcaggctttgggcagggtaacgccggtttgccccatatatttgccgttgcggtctttgtatgaggtttcgcagatttcgtcgctctcgaagaagaggacttgcgccacgccttcgcctgcgtagattttggcgggcaggggggtggtgttggaaaattcgagggtaacgtagccttcccattccggttcgaacggggtaacgttgacgataatgccgcagcgggcgtaggtggatttgcccaagcagacggtcaggacgttgcgcgggatgcggaaatattcgaccgtgcgcgccagtgcgaaggaattgggcgggatgatgcagcagtcgtcttcaacggtaacgaagtttttcgggtcgaagtttttgggatcgacgatggtgctgttgatgttggtgaagattttaaattcgtttgcgcagcggatgtcgtagccgtagctggacgtaccgtaggagatgatgcgtttgccgtcggcttctttgatttggttcggctcgaaagggtcgatcatgccgaattcttcgctcattcggcgtatccatttgtcggacttgatgctcataatgttttccttgtttcttgcagtgttcggacaaagcattgggggatgccgtctgaaaacggggcttatttgtttttgggcagtttcacttctttaatcatgccgttttcgcatttcataatgaagagggtttcgccgttttgcgagacggtaaatctgccgtgtgccaagccttttttgaacgtgcccgagagtaccatgttgcggaatttggtactgtcggaattgaacggttcgataaatatttcgcggttggcggcaacggtataaacgccttgcccgtcgaatttgccgtttttaaacgaaccggtatagttgcgcccgtcttggcagcgccatgtgcctttgccggcgggtttaccgtctttgccgacattgccgtcgtaggtgcagcctggttcttgataggaagtcaggacggcggccgaagtggggagggcgaacatcatggcgggcagtaggaatgcgagatgtttaagcataagggttattccattggattttggttgacggtattttgtcgtgaaaaagccgtctgaaaaatcaatcttgccagccgcccaaataggaaaccagttcttccaacatggtgctgacggattccgccatcagaatttgcgaggcgaaggcaaggccggcggcatcgtcgccgttgctttcggcttcttcctgcaatacgtcgaggtattggatgcgcttgagtgtgaagtcttgagtgaggataaaggcaatttgttcgcgccacaccaagcccagttgggtaacggttttaccgtttttgacgtgttgaaccacttcgtcggcggttaaatcttgtttggatactttgacgacgggaacaatatcgcccgtacctttgagttcgcaatcgctgtctaattcaaaaccgccttcgcaatgcccttgcaacagccagccggtcatcaaggaagagggcgattgcttggtattcggcagcgaggcttccaaaccgcccaaagcttcgcgcagcttggtcaggatgttttctgctttggcggaagccgcgttattgacgagcaggtagccgtggcgggtgttaaacaccgcttctgtacggctgctgcgggtaaacgctcggggcagcaggtcgtctgtaatttgctctttaagctcttgtttttctttacggccgacattgcgggcttcattgttttggatttccgctaccttctcttccaaaatatcgcggatgacgccggcaggcaggactttttcttcttttttcagggcgacgcgcaaggtaaagtcggcagggaaaacgagttcaggggagaatgaaaccggtgcggtaaagccttcgctgaaccagtctaagccttggcaatgggtaaattcagcttcagcaagtttgtcggcaagtacgtctgcctcaggcagcttttctttgttgagcggataaaaactaatctgcttgaaccacataatgtttcctattgtttgaaatgtcgggaattatttgctgaattgttttttcacactgactttggttttcttcttgaagcggtttttctcttcctttcggccttcgcgtttctcaatacggttgctcaggctgacgcggcgcagcggttttttcttcggtttgtcttccgcattttcatacgggttttccgaaacattgtattgaattctgagcggcgtgccttgcagattgaaggctttgcggaacgtttgggtcagatagcgcgtatagctgtcggaaatcgcgtgcagcgaattgccgtgtaccacaattacgggagggttcatgccgccttggtgggcataacgcattttcggacgcaccaagccggcacgcggcggttgctgacgctcgatcgcgctttgtaatacgcgcgtgattttcggcgtcggcatcttaatcatcgccgcgttgtaggcagcctgaatgctgtcaaacaaaccgtctataccgcgctctttcaatgcggaaataaagtggaacttggcaaaatcgaggaaatacagtttgcggttgatatcgcgtttcacttgctcgcgacgttcttcgctgatgccgtcccatttattgaccgccaccaccaaagcacggcctgcctccaaagcgaaacctgcaatcgtcgcatcttggtcggcgatgtcctgctgcgcgtccaataccaaaacagcgacgtttgccgcttcaaccgcctgcatcgctttgataacggagaatttttccactgcttcatccactttgccgcgacggcgcacacctgcggtatcgatgatggtaaacggtttgccttcgcgctcgaaatcgatatggatactgtcgcgcgtcgtacctgccatatcgaaggtgatgacgcgctcttcgccgagaatggcgttaaccagcgtagatttgccgacgtttggacgaccgataacggcaaaaacaggatgtcttgcatcggcttcttcggcttccggctcggggaatttttccaaaatatcttcaatcagataatacacaccatcgccgtgtgcacctgaaataacataagggtcgcccaaagcaagttcgtagaactcggcggcaagtacagccctattgcccccctcgcctttattcacggccaaataaacagggcgcggactttggcgcaaacggtcggcaataatcttgtcttgcggtgttaaaccggtacggccgtccaccaaaaacacaactgcatcagcttcatcgacagcctgtaaggtttgttttgccatttcgtgcaaaatgccgctgtccacaaccggctcgaaaccgccggtatcgatgaccaaataaggtttgctgccgactttgccgtgtccgtaatggcggtcgcgcgtcagaccgggcaggtcatgcacgagcgcgtctttggtgcgcgtcaaacggttgaataaagtagatttgccgacgttggggcgaccaacaagcgcgatggttggtttcatgattgagtctttctgtgtcaagtgccgttcgggagaactgaacacgagcaggtgtccgttggacacggcggatgggttttacgggaattgccgtaggatagtgttgtctgaaatgccgtctgaagagagggtggcatttcagacggcatttatttcagcgaatcaagtttcatttgaaccaattcgcgaccgacagaatcttgaggcattttttctaaagcctgtccgtagttttttaaggcttcctggctttttccctgtgcggcatagacatcgcctttggtttccatcagcaggggggcgaagtccgcttcaaccggcgtatcgagcgcggcaagcgcggcatcgtattttttttgttgcaacaacacaacgcccagacgctgcgccgccaacgcttgaatcaggctgtctttttggttggacaacacccatttcaaatggccttcggcaacatcgtaacgctgcgcgtcaaattcggttgccgccgccatcagtgtggcttgggcggcggaaatggaatgcgggtagctttgttggagtttggtcaattcggcattgatttcgctttgcggggctttgctttgcgccttttctacgatgtttgccagcaccgccgccgcttcctgattttgggaaactttacggttttggtaaaccgtgtatcccaagtagccgagtgccgccaaaatcagcaaggcaaacagccatttgcccgtggttttccaaaaatatttaaagttgtctaactcttgttgttcttcgagatgggctgccatttatgcgttcttccattgttgtaaagtaggggttaaatcctcggcggcgacagtttgctgaccgtgtgcgccgttcatgtctttgagcgtaaccgtaccgttcgccagttcgtcttgcgcgacaatcagggcaaagcgtgcgccgctgttgtcggcttttttcatttgcgctttcaggctttgatagccggaatgctgcattacattgaaaccttgcgcgcgcaaggcttgtgcgtatttcatcacctgcaagtccgccccttcgccttggtgcattgcatagacatcaggcgcagcgttcacttccagagagccgtattcgctcaccaaaagcagcagccgctcgatacccattgcaaagccgatagacggcgcaggtttgccgccgagttcttcaatcaagccatcgtaacggccgccgccgcacacagtcgcctgcgcgccgagtttgtcggtcgtccactcaaaaaccgtctgattgtaataatccaaaccgcgaaccaagcgcggattttcaatatattggatacccaaaccatccaacatcgccttgaagcgtacatagtggttttgcgaatcctcgcccaagtaatccaccaaacgcggcgccgcgttgcagatttcctgcaaatctgggtttttcgtatccaaaacgcgcaaaggattggttttcagacggcgtttgctgtcttcatccaatttatcttcataacgggtcagatattcaaccaatgccgcacggtgtgccgcgcgttcctcacggttgcccaagctgttgatttccaaagtcaggtattcgcggatacccaatttttcccataagtcggcagacatcgcgatgatttccgcatcaatatccggcccttcaaaacccaaagcctcgataccgacctgatggaactgacgataacggcctttttgcggacgctcgcggcggaacatcggccccatataccacagcttttgcgggctattgtacagaaggttgtgttcgaccaccgcacgcaggcaggaagccgtaccttcaggacgcaagctcaaactcaaagaatcgtttgaatcggagaaggtgtacatttccttgccgaccacatcggtttcctcgccgatggagcggacaaacaaaccggtttgctcgacaatcggcgtacggatttgctgataaccgtaagcgcgtgtccagcggccgaccgtatcttcaaacgcctgccaaaacgcagccgtcagtttgaaatctttttgcttgacaggcagaaggtcgttcatgcctttgacggattggattttttgtgccatttcaagtaagaatgcttaaatcaaattgcgggcgattatagcggattttaaagggtttgtgaggttggaggtggtttgcggacggcatttgacttactctgcacgtgcttgcctgatttgtccgactgtaaactccgtctgccgttttgggtgttgtgtgaaaaacaatttatttgaaattgtctcggcttttttcggtatgacagccaaaatcttacctgccaaatttccctcacgggtttgccaagcatccaaaaactgcgccctgctcattgaaacatgccccagcgacgggtcggcaagcaaaaccgtattgccgtctataccgcgcaataccgaaaaatggtcgtctttgcggtatttcagatacacgatgacggggattttcaactgcgcgagctgctcgaaagacagggcatagcccttcgcctcaaaacccaaatcaggcataatgcgccgcatatcctcaaacgacgcgcgcatctgctccttatccagctttttcaacacttcttcttccgtcagcgtttgcccgtaaaaattgttcaaaagcgtcgccaccgaagccgccccacaggaaaaatccaaatcctgctttacaatattgaaatcccgccgcgctttccaactctgcactttgatttttccgtaaacaacaggattatcgttaaacatcggtgcagcattcaaacgataagataaagaaacgacaacacacgccaacagaaaaacatatttgaacttcatcatattgtccacataaagggcagcctgaaaatctttcaggctgcccttgtcaaattattcctagctttcggcttttttggcaaaccaaacaatccgattacccgcataatactttccatttattgaaatccgacaagccgcgcccaaaaaatgccatgcactgtcgatttccgcagcaatctttgtaccgttttcttcaaattccaaatattcacccaataataaacttgaaacagaacgcgtgggcagcaagtgcccaccctacgcttattcaaataatttgattaaataaagaataaagaaaatgcatcaggaacaaaattataatctgccacctgactcacaccgcttttaaagtaaggggcatcaaaatcaaaaccgcaaaaaaaataatttttgcattgatttttaatagatttaaaattcgaatatagtgtttctctagatttaaaaagtttatctttatctatatatttgatgctttccctatccaaaataaatatttcaaacattaaaaaatcattacatgaccaagccaaatcataaatttgattcaaatgggtatcataaagataaaaataataaggtttgggaacaggtaaaatatttaatggaaaaggaggactaattttcttaatatctgatgactgatatccatatctttctatattcttaaaaatttcatctttcttaagataacaagacattctgacaatcacaacctgttcatcggatatattatctatttgcatggcgcgtataacacgccatgcctgattaaaattagtctcccttaccttaaaatctattatcttttccaaagatgaaaatgccccttatcttgaactctccagttagaacctggaagtttcgtacctcttaaatgtgtattaatatttcttatagtttcattaaaatgccacgcgctgccgatttcaacggtaattttcgtaccgctttcttcaaattccaggtattcccccattagctaacgcaaagaagcagacgccatttcggcttcgttatgataaacccgccttccgttgatatagacttccgcccctgtccgctccaaattccaaaaattccgtactgaaatttccatatcccgatattgtgcagaccatgttttttcgaaggttttcataaaatttcctatacctgtccaatcggcacatatcaattgcattattacatctcaatacgataaatatttcttaagtcaaaatgcaagcctgaccgtaccttaactgtcaaaattttattattttttattgattttaaaacaatttctgtaaaattctcttcgctttctctcttttttagaagcacataagaaaaaataaaacttccccgattaaattcataaatatgtttcaaccattcgcctcctctttctgtaagacaagattcagtttcattcttccttattgtataaatatttccttcacaaaatctgaaataaatccataaatccatcttatccataattaaagaaaaagtttcacctcgagattttgtcaacaattcgcaaggttgcgatgttgcaatcaaatagccgaaagacattttttacctcatacatggtcgaaatcagtttctgttagttcagaatccattttttcgtcaacaactgaatccgcatttttgaattaacgttttcatcagctgccgtttatctaaaccggcaggttcagtttcaaaataagccttatatgaagactgtaagcatttcagaaaaagatcatcagaagacatatctgccgaatcaaatacaactgttttgattttggtacttacccaaaaccctttttgctctttttctactatacggaaattcagaatatttccaaccgaatcaaaagcacggtaaacatcatccatcaaatcctgcggctctattttcttttccaattccgacaatccttgaaatatatccaaagacacatcttcaaatagaaaaaaaggaggagttagaagcggtttttccatgatctgtccgtagattttgattcccaagggcgatgacgaccaattccctgtccaggcaaagtcttgcccgtattatccgtaactcgacgatgataatggggaaattttccaataggatgacctgttctattaccgaaaggggctatccgcatattattgccgattttaatctcacgtccatatttagcaaaggaaacaacctttcctgcggcgcctacaccaccaggaattgcgcctaatccgccagcaatagcaacatctctaacagaagctggtctgcctgtcgttgcataactaaaaccatgctgtgtccacataccaatggcagcaccacccaagatagccaatggaagaaacgccccctctgtctccttcatctccttttgagaaagctccgccaactgcatcggtgcatctgcccgcgtgtggaacacttggtcttcaaatgcctgattgtccaagccgtttgccattgcgggggcaatcatagacagcatcattacggctgcggtgatttgttttttcataataactcctttggattacaaggttggaaaatcaaagccctgcttagaacgtatgttgcacacccaatttcaataggtaaatcagattgcaaatccagcaatttgaatattgtcattgttccgtgcaaaagggatttttattgatgagttgtgtactgggtttcagcttggctttttagataatcttttcacaagaacatacatcaatactgtccaaaaaaaaagatttgataaatatattgcaacatattttattccacctccatccgaaacagaaaccaatatatttttaattaatacatagctgattattacatttattattcctataatatataaggatcttgccaaaattttttttgattttattttaggaatatctcttatccatgctaaaatacagcccaatgtcgaaaagaaaataacagcaaacactaccttacctcctctcacttccaaccaaaccgatagcaggtttggttggaagttggtttatttattatttaacggcgaatgtcagtgttcttacccgtagaacctgcataaccatttatgccaccagcaacagtccccactgctacacctcgcataccattaatcagaattcttcctattttttcgaatccactatttcttccaaagatgcagcaaacgcaggttgagcctagacccaatctacgtttgctgccgcatctgatccctattgtttcttatccttacatcttcctgccttgtcaatcaaataaagacagaagactatacaaaaactgaccgacatactgaaaatacctatccccttccatgcaatctccgcaccattgacccaatagattagactgagaaacaacaaagccacagtataaatcaacgtaaaaaatattgcgtaaagcacaataaagggaacttttatctcacggttgttttttataatatattcagcaacttgatttccgaatatacctgataaaaaatatagtattagatcatccatttcgtttatcttctatgttttcccattgcggcgctagaagactgatttaatgctgcaccatttgcacgaataactgcattaggaatagcatttccccctttccaagcagaacgggcaaaaacactagtagtaatccctgcaccgcgcaacatcgcactgctatatccgccgcctatcataccaccagcggttgcagccaaggtacttcttgttgaagcaaattgccctgttttaattttagaaatgccgtgattagcccaagcactaattgcccctcccatcaaagcacctgccacaataggaagaaacgccccctcagtctccttcatctccttttgagaaagctccgccaactgcatcggcgcatctgcctgcgtgtggaatacgtatttttcaaatgcctgattgtccaatccgtttgccattgcgggggcaatcatagacagcatcattacggctgcggtaatttgttttttcataataactcctttggattacaaggttggaaaatcaaaacctgcttaaaatgtatgctgtacgccaaatttcagttcggaactgctttgccctgaaacgttgaaacgtgcggatgcgtttaaagccgtggttttggtgaaaccgaaacctgcgccgaaatgggcgtaggtggatgtgtttctggaggattcccgtttgccgtccgtccggtcgggctgcctgcccagccattggatgcctccggtcaggctgattctgtcgttggcagcaaatgagatgttggggttgagcagcaggtagttgcccgatttgtagcggatgccgtctgaaagggttttgctgccgttgatgcggtaggcggcggtgagggaaaggacaatcggatctatggctttgtaggtggtggcgccgatgagccaggattttcccgacgaggctttgttgcgcgatttttcgtaaaccgtgctttcaagaaagctgattagggcggggtttttgtcgtctttaaggaaagtgtggctgatgccgagggatacgtcggacatccgtttgttgcgggttttgctgttgccgtcgagtttgcgttcttcgtgccacagatagctgccgctgccgtaaatgtcggtattcccggtcagtccgtagcgcaaaccgagcgtgccgacgagcatatcggtattgctgccgttttcttggatttcggtcggaatggggataaacgaggttgcgccggtttgaatgtaaaccggtgcggcaagttcggcgcggttgttttcgctgttcaggtaggtaagggaagtttccagtttccattttcccttgtcggtcattatgtcttcaatcgtcaagggcaggtcggcataagtggataaaggcaggatggcgggcaaggcgggcaaaaagatgcgcttcatatttctcctattgatattaattcttatttactaataataatgaatatccgataatcttgtctaaataaatttttaaatcataaaaaacaatatgtttgtttttgtcaattatgtttcgatatgccgtctgaaaagtttgtgaaaaacggttacaatccgccgcatgaaaaaacgcaataatcctcttccgctgttgaacggtgtcaaacccagttatttggtgctgccgcatgaaaagcagttttacgggctgccgctgctgcattttctgtgcatccgctttccttttgtgggcgcggacgattggcgcaggcggttgaacagcggttttgtggtcggttcggatggtgcggcgttggacgaacattctttgttcgagccgggtaaggtggtgttttattaccgtgaaaccagccgtgagagcgagccgcgtattccgtttgaagaaaagattttgcatattgatgagcatttgattgtggtggacaaaccgcattttctgcccgtcatccccagcggcaggtttttgcgggaaaccctgctcacgcgcctgcgtttgcggcctgaattgcagcatttgaatgttgaggacattacgccgctgcaccgcttggacaaggatacggcaggcgtgatgctgctgtcgcacaatcctgccacgcgcggagcctatcagacgatgtttcaaaacaaaacggtatggaaaacgtatgaggcgcttgcgccgacaaggacggatttgccgtatccgctcgatgtggtttcgcgtttggtgaggggtgagaaattttttacgacgcaagaggcggaaggcgaaccaaacgcacatacgacggtcgaactgattgaaaacaggggggaattcagcctttaccgccttacgccgcatacgggcaagaaacaccagttgcgcgtgcatatgatgggtttgggtatgccgctgttgaatgacgcgctctatcccgtgccgtctgaagcgggcagcgaggattatcggaaacctttgaagctattggcaaaaaagattgcgtttgcagatcctttgtcgggtcgggaaagggtgttttgcagcggattttgcctataatgagagggaacgcaaacccgtatcggcggatgccgccgatacgggttttacattatcgatgccgtctgaaaggggttttatccgttcaggcatacgggcgcgaagcggaggatggtgtcgcgcaggacgatgagtttgccgtgaaagaaatgcgtggaaccggcgatggtaatgacgggcaaatcttgcggttccgcccatttcagtgctttcccgatttcgacgacttcgtcttccgcgccgtgtatcatcagcgttttggcaacgttgggaacggcggacggttccggacggtcggtatagtggcagactgccgcgccgatgagcagcaataaatcgggtgtgcgcgcttgtgcggcaaatgtggcgacataaccgccgaaggagaagccggataaggcaaattcgggggcttcggggtgttgggcgcgggcataatcgatgacggcgaggcagtcttgcgtttcgccgcgtccgtaatcatgtgtgcctccgctgccgcctacgccgcgaaggttgggcaggtagcagtggaagccgagtttgcttaaggctttggcggcagtttggatgactttgttggtgtttgttccgccctggagggggttgggatgattgatgacggcaacaccgcgtgccggtacttgttcggacgggatatggatggtttctaaaatgccggcaggaccggatatgtgtatggtttcgggtttcagcataatgatttcctcttgattttccgcatgttccgatgcagccgtgaagatagttgcttaaaggtggaaatgcttgccgttgttggggttggacgctttcaggccggcaagcatacggtggaagtccaatccgtatgcgttgctcagtttgtcggcacgttttttgagtttgtctatgttttgctctttggggctgctttggaaggccattaccgcgacattgccgtggctttcggcaggaagttccaagacgcgcccttcaaaaacgctcaacaaccgttcgatgaagcgttggtagcgtttgtcgccgctccaccagttggttacgaatatgccgtctgaagagagtgcgttgcggcagtctcggaagaacggttcttcaaccagcgcatcgatgatttgttcgccgtcgaacccgtccaccaaaatcacatcggtgttgtggcggaagactttgatatattctgcaccgtctgcttcaataatttcaaatttctcgccctcgaaaggcaactcgaacaggttgcgggcaatggcgatgacctgcggattgatgtccacggcggtttggcgcgtgtcgggcaggtaggtatctatccagcgtgcaaacgagccgccgcccaagccgatttgggtgatatgttgcggaagagcgtcggtaaacagcagccagcccatcatcgcgcggctgtaagagagcaccagctcggacgggtggtcgaggttcatcgagctttgaacggtgtcgctgcccaagtgaagcgaacggatattgccttcttcggaaatgccgacttcgggaaagccggattttgcaggacgcaggcggcggtagggatgtcttgccatcggtgtgaacggtcggtttgaaaggcggatattttatcagaatgccgatgcttgttctgtttcaaattaatttcttttcaaataaattacttattcggatttgccggggctttcggataaattccttgccaaggtgcggcattgcctgcataattcgctttctttgccggtatagctcagttggtagagcacctgacttgtaatcagggggtcccgagttcgactcttggtgccggcaccatttctgctgatggtgttgcaaaacatttcagtaagccggtatagctcagttggtagagcacctgacttgtaatcagggggtcccgagttcgactcttggtgccggcaccagatttgacagtccgattgtgtaaaacagtcgggctgttttgcatttgcggcacggtcggtggcagggctgcgggcatttcactataatagcccgtttcaaactgaaaaggccgtctgaaaagggcggggtaacaatatctgatgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggttaaactcgaaggcggcgtgtggatggcggaaacgactgaatttttgcaaatgcgcggtattccggtttgtgcgcacatcggtctgaccccgcaatccgtgtttgccttcggcggatataaagttcaggggcgcggcggcaaggcgcaggcgttgcttaacgatgccaaggcgcatgacgatgcgggggcggcggtcgtgctgatggagtgcgtactggcggaactggcaaaaaaggtaactgaaactgtttcctgtccgaccatcggcatcggcgcgggtgcggattgcgacgggcaggttttggtgatgcacgatatgctcggcattttcccgggtaagacggcgaaattcgtcaaaaactttatgcaggggcatgatagtgttcaagcggcggttcgggcgtatgttgccgaagtcaaagccaaaaccttccctgctgcggaacatatttttgcagattgagcggtttacatgcagcatgccgtctgaaagccgtttcagacggcattttgttttgccgtgcgcggcgcgtataatcggcgcgttttgtcgggcaggaagcccgaaggataaggattaccgttatgcaaatcatacataccattcgagaactgcgcgcgtggcgtaaaaatgcgggaaaggtggcatttgtgccgaccatgggcaatctgcatgaaggacatcttgcgcttgtgcgtgaggcgaaaaaacgcgcggacagtgtcgtggtcagcattttcgtcaatcgcctgcaattcggtcagggcgaggatttcgacaaatatccgcgcactttgcaacaggatgcggacaaacttgccgccgaaggcattgccgttgttttcgcgcccgatgagaaagaactctatccgaacgtggaacagcgttacaacgtcgaaccgcccaatctgcaaaatgagttgtgcggcaaattccgcccggggcattttcgcggtgtggcaacggttgtttctaaattgttccacatcgtttccccggacattgcctgttttggtaagaaggattaccagcagcttgccgtgattaaaggttttgtcgaagatttgaattttgatgttgaaatagtgcctgttgatacagggcgcgcggaagacgggttggcactgtcgagccgcaaccagtatttgagtgcggcggaacgcgacgaagcaccgcgcctgtaccgcgaattaaaggctgttgccgaatccttggtgcagggcagtttggattatgcaggtttggaaaaacgtgccgtccaatccctgacagaatacggctgggtggtcgattatgtcgaaatccgccgcgccgatacgctcgaagtggcgcgggcgggagataagaaactggtggtcttggccgccgcctgtctggggacgacgcgcctgattgacaatttggaaataaaactcccttaaaccgcaagcgtcgggaatgccgtctgaagcggatttgcgtttcagacggcatttattttttgaacggggtttcgcaaatctacaaacgattctgcttgtgataaagttacgcctgattatatgccgtctgaaggttcggacggctgtcggataaaggatgattatgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataatgcaggtccatcctttcagacggcataaggtttgccgggaagccggggcattcgggcaaacggcacgcagttcgcacgcgttttgcacggcacgccgaacccatcggccggcaggatggcatccgttaaggaaattctgatgaaacacaccgtatccgcatcggtcatcctgcttttgaccgcttgcgcgcaattacctcaaaataacgaaaacctgtggcagccgtccgaacacatcagcagttttgcagcagaagggcggttggcagtgaaagcggaagggaaaggttcgtatgcaaatttcgattggacataccaaccgcccgtggaaaccatcaatatcaatacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcgtgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgaaatcggtatgccgtctgaaaccgaaaccccggaacgctgtgcggcgcgcacgagataaggcggacagatgaatattgcggacggacggcaggcgttttccgcacctgcaaaactgaatctcgatttgaggattaccggcaggcgggaagacggttatcacaatatcgaaagcatattctgcctgatagatttgcaggataccgtatatttgaaaccgagggacgacggcaaaatcatcctgcacaatccggttgatggcatgccgcaggaagtagatttgagctaccgtgccgcatcgttgctgcaaaaatatgcgcgcaaccccgccggcgtggaaatatggctggacaaaaaaatcccgacaggggcgggtttgggcggcggaagctcggatgcggcaaccgttttgctggtgttgaaccgttggtggcagtgcggtctgacgcagcggcagctcattgattcgggcgcggctctgggggcggacgtaccgttttttattttcggcaaaaatgcgtttgcgcggggtataggcgacaggctggacgaaatggatattccgaaacagtggtatgtcatcgtcaaaccgcccgtccacgtttccactgcaaaaattttcacacacgaaagcttgacacgaaattccgcctcaagcataatgccgactttccaaaatctgcaaccgtttagaaatgatatgcaggcagttgtatttaaagaataccctgaagtttggaaagcctattccgagttgtcccgatatggatttgccttaatgacaggttccggtgcgtgtgtattcacggcgtgtcaagataggaatagcgcatacaatatataccgacaagtttcagatttgtacgaggcatatttggcagagggtctttcaaaacatcctttgttgtccgtataaacattgttggggagtcgtcaagcggttaagacactggattttgattccagcatgcgaaggttcgaatccttcctccccagccaagtcaaacgagttggggagtcgtcaagcggttaagacactggattttgattccagcatgcgaaggttcgaatccttcctccccagccagccctttttggggagtcgtcaagcggttaagacactggattttgattccagcatgcgaaggttcgaatccttcctccccagccaaataaaagcgtgtaagcctgcttacacgcttttatttcatagaaataaaaatattgaaatgcctttgtttgtgtcggatgttgcaggtataatgtcgggcttggtacaagcagagggaagcattgtgttttctgagcggaagttaaacataaaatcaggtgagaatatggctgcgtacgacagtttgatggtatttacaggcaatgccaatcccgaattggcacaacgtgttgtcaggcatttggacatttctttgggcaatgcttccgtatccaagttttcagacggcgaagttgccgtcgaactgttggaaaacgtacgcgggcgcgatgttttcatccttcagccgacctgtgcgccgaccaatgacaacctgatggaaatcctgacgatggcggatgcactgaagcgtgcttcggcaggtcgtattaccacagccattccgtatttcggctatgcgcgccaagaccgccgtccgcgttccgtccgcgttccgatttctgccaaactggtggcaaatatgctgtattcggcagggatcgaccgtgttttgactgtcgatttgcatgccgaccagattcaaggtttcttcgatattccggtggacaatatttatgccaccccgattctgttgaacgacatcaaacaacagcggattgaaaatctgaccgtcgtcagcccggacatcggcggtgtcgtccgcgcccgcgccgtggcaaaatccctgaatgccgacttggcaatcatcgacaaacgccgcccgaaagccaatgtggcggaagtcatgaacatcatcggcgatattcaaggtagaacctgtctgattgtggacgatatgattgacactgcaaatacgctgtgcaaagccgccgtcgccctgaaagagcggggggctgaacgtgttctagcctatgccagccacgccgtattctccggagaggcggtcagccgtatcgcctcatccgaaatcgaccaggtggtcgtaaccgataccattcctttgtctgaagcggctaaaaactgcgaccgtatccgtcaggtaacgattgccggtctgttggccgaaaccgtccgccgcattagcaatgaagaatccgtctcatatcttttcaatgaagaagtgatgacaggcagcatgttgctgccataagcccgaagccgtcttaagctggtcgcggccgatgacggcgattttacctaacttggagtatttaacatgacttatgaaattcaagcctctgttcgtgaagcacaaggcactggtgcgagccgccgcctgcgtcgcgaaggccaaatccccggcattctgtacggtgaaggtcaagagcctgttgcaatcgctgtggatcacaaaaccgtattctacgcattggaaaaagaatctttccatactgcgttgattaagttgtctctgaacggtgaaaccaaagacgttatcgtccgtgatttccaaatgcacccgttccgccgcgaagttcaacacatcgacttccaagctgtgaaagccgatcaacttgtacgcatccgtgttcccctgcacatcgttaacgctgaaaattcccaagcggtcaaactgcaaggcggccgcgtatctctgttaaacacttctgttgaagtagttgctttgcctgccaacatccctgctttcttggatttggattgtgctgaagtggttgccggcgacattctgcacttgtcagacatcaaactgcctgaaggtgtagaaagcgtttccctgaaacgtaacgaaaatctggctgttgctaccgttaccggtaagaaacgctaattgatttcagcagcagggcggcgcgtatgcaatacgtaccgccctgttgttttatgccgtctgaaccgtgtttcagacggcatttctttatttgttggaaaaacgggatatttgaaacggcagattactgccctgtcagacacgcccaaagcctttgccaccggcttcttttttttacattttccagtgcgacgatttctttttcggcaatggtgtatccgttttgtctgattttgatttttcctaaaatttgccctttttttactggggcgggaatcggctgtatggtttctagaatttgttctgccattttcgcttccttatgtggcagagtgatgtaggcttctttgaggaagcctgcgcggacggtttttttgctgcctccggaaatttggatttgggcaacggttttgcctttcggatatattttgggcgtatcgaaggcctgcaatgcccagttcagcagcttgctgttgtctgatgcgcgtgtttccgccgattccgaacccaatgtgatgacaaggatgtgcctgccgttgccggagtatgacacggcaaggttgtagccgccgctttctgtgtgtccggctttcagaccgtttacattgttgtccctatataaaaggatattgcggttgttttgttctatatttttgaatttgaaagatttgatggaaaacagcgggtaatattccggaaagtcgcgcatcaatgcttcagacagcagggcgaggtctttggcggtggaaacctgtccttctctactcaagcctgtcgggtttttgaatacagtgttcttcatgcccaagcgtcgggcttctttgttcatttgttgcacaaaattttcaatcgagccgttgcccagccggccggcaagggttagggcggcatcgtttgcggatagtgcaatcatgccttttaagagtttgtcggtgctgaccgtatcgccgggacgtacaaacattctgcttccttctgaagcccatgcggattcgggtatttttaagttttcttcagattggatattgcccgatttcatgtttttgaaaaccagatatgcggtcatcagttgggttagtgccgccggttcaacaggggtattgatgtttttggcggataaaatctgtttgctttgaaggtcgataacgatgtgtgccgctgtgagggtttcgggtgtttggaacgtgggggcggcgtgtaccgtcggtctgttgggcgcgggcgatgcagccgttgcgtgagaaacgcctaagatgatggaaagcaggacgggcaggattttatgtgctgtcatgaaatattctaattgtgtgcgtgtttcagtctgccgattatacgcttagggtgtctgatcgggcggatttttcttgatttcgcgccgtcttgggcgtatggttttgggttttgcgattttaataaaccgattatcccatattgaattatgaacacgccccttccttattccgattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcatgctcaaggcgtggcattgtccgcacagcgtttgggctgccgtgccgttatcgttatgccggagactacgccgaaaatcaaagtggatgcggttaaaagccatggcggcgaggtggttttgcggggcgtttcatacaacgatgcctacgattatgcgatggagttggcggaaaaagaagggttaacctatatcgcgccgtttgatgatcctgatgtgattgcgggacaggggacggtggggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcactgcggtcaaagtcgtcggaaacgaaaccttccgcctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggagacgatgaaaaagcgcatatctttgtcggacttcaagcggcaggcccgcaggatttggcggttatcggcagccggttggatgaggcgggattgcccaatgtcgatttgaccaacaatgagattgccaaaatccatatccgctatatggtcggagggcggacggacaaagtagaaaacgagcgtttggtcagttttgagtttccggagcgtccgggggcattggcacgctttttgaaccatatgcagggagggtggaatattacgcttttccattaccgcaaccacggtgcggattacgggcggattttggtcggtatcgatgtgccgccgcacgatgccgccgcatttgacggtttcttggaaagtctgggatacagctatcacgaggaaacgcaaaatgccgcgtacaagctgtttcttgcctgacgcttgaaagcacaatgccgtctgaaagcctttcagacggcattgcgctttcatggttaaatcgaatattcaatcagttcgttttgagagaagacataaacctgtttcggaatcagcttcaattctttgccttcggcgattgggtaacgcgcggcatcgctgcctgccagcgtgatatgtacgtcctgtttgtcgtgttttaccagaatatgcgtcaatgcgccgacggcgtggattttttcgatttcggcacaaatcatcggtgtttcgtgttcggcggcgatctgccattcgtgcgggcggatatagccggtggcggtttgttcctgccatttgtattgcgcgtccaatttccacgcgaagccgttgtaatgccagaagcctttttcgatgcgtccttcaaaagcgtcggtttcgccgaggaactcggtaacgaaggcattttcgggtttgcggtaaatagcttcggcgctgccggtttgttcgattttgccgtggttcatcacgacgatttcgtcggaaacttcgagggcttcttcttggtcgtgcgtaaccagaatgctggttacacccaggttgtgatggatgtcgcgcagccaggtgcgtaattctttgcgtactttggcatccaacgcgccgaagggttcgtccaaaagcaagagtttgggttcgaccgcaagcgcgcgggcgagggcgatgcgctggcgttgcccgccggagagttggtgcggataggattttgccaaatgagagagctgcacgagcttgagtaattcttcgactttggcgcggatttgtcctttggacgggcgttcggacttgggcaatacggtcaaaccgaaagcgacgttgtcaaacacgttcatatggcggaaaagggcgtagtgttggaacacgaagccgactttgcgctcgcgcacatgtttggcggttacgtcttgcccgtcaaacaggatattgccgccgtcggcgttttccagtccggcgataatgcgtaaaagtgtggttttgccgcagccggacgggccgagcagggaaacgagtttgccggtggggacgttgaggttgatgtttttcagcgcgtgaaaattgccgaagtgtttgtttaagttttggatggtgatactcatattgcattcctttcggcggcggcgagttttttgtcttgtaatttggtaatgatgttctgcaccgccagcgtcgccagtgccaaaagtgccaatacgccggagagggcgaatgcgccggtgaagttgtattcgttgtagaagatttcgaccaaaagcgggacggtgttggtttcgccgcgtatgtgtcccgataccacgctgaccgcgccgaactcgcccatcgcgcgggcgttggtgaggatgatgccgtagagtaacgcccatttgatgttgggcagggtaacgcgccaaaacatctgccagccgcttgcgccgagtatcaatgccgcctgttcttcgctgtcgccctgtgcctgcatcagcgggatgatttcgcgtgcgacaaaggggaaggtaacgaacagcgtcgccaaaacaataccggggatggcgaagataatctgtatgccttgcgcttcgagccagccacccaatgccgtatgcgcgccgaacaataagacgaacatcaaaccggccaccacgggcgatacggaaaacggcaaatcgagcagggtggtcagcaactgcttgccgcgaaaatcaaaacgggtcagcagccacgccatcgccacacccaatacggcattgacgggaacgacaatcagcgcggtaatcagcgtcaatttgatggcagaccacgcttcgggatcgtttaaggatttcaggtacaaatcccaaccgccttttaaggcttcgtaaaacacggcgacgagcggcacgaccagcatcagcagcagaaagcccagcgcggcggcaatcagcaacacgcgcagccggcgcggttcggtcaggttgggattggcggaatagggtttcatggcggtggtgttctctggttggttttaaaatgtttggatgccgtctgaaaaaccgttttttgtggggcggattcgttttcagacaaccttttattgattaagggaataaaaacgtctagctaccgtcattcccgcgcaggcgggaatccaccgcagggcaacaggaaaacagaaaataaataaggcagccgaaattcaccaatggattcccgcctgcgcgggaatgacggtaacaggtatttcagacgacctcaacccttcgcgcccgaacgcctgcccaacgcccactgcatcacgttcagcgcaaacagaatcacaaacgaaaccagcagcataaacaacgccaccgccgacgcgccctgcacgtcgaactgttccagcttgcccgtaataatcagcggcaggatttcagaaaccatcggaatgttgcccgcgataaaaatcaccgaaccgtattcccccgttgcccgcgcaaacatcattcccgcgccggtcaagagtgccggtgtgatttcaggcaagaggacacggcgaaacgtagtccaacggcttgcgcccaaagttgccgccgcttcctcatattcgcccgacaattcttccaataccggctgcacggcgcggacgataaagggcaggctgacgacgaccagcgcaatccaaatgccgacgggtgtaaacgcgattttgatgcccaaaggctcgaaaaaacggcctatccaaccgttgggcgcatacagggttgccaacgcgatacccgtaaccgccgtcggcagcgcaaacggcaaatcgaccagcgcgttcgccagacccttgcccgggaattcataacgcaccaatacccacgccaccagcgtgccgaacacgacattggtcagcatcgcataaaacgacatccgcaagctcagccataccgccgccaacacgttcggctcggcaatcgtgttccaaaagccgccccagccgatttccgccgccttcgccgccatcatcgcaaacggcaagaccacaagcagcgacaggcacaatacggtcagaccaaggctgagtttgaagccgggcagtacgccgggcgttttgagcgctaacataaaacaatgctgaaaataaggaaaaggaaggactactttaacgatgccgtccgaaaaacggaaagaatggaaagtttggtgcaaagacgaatttgttataaagcggttggcagtttctcaagcgggcgcgatgttttaaaatatagtggattaactttaaatcaggacaaggcgacgaagccgcagacagtacaaatagtacggcaaggcgaggcaacgccgtactggtttaaatttaatccactataacaccttgttttgacggaaaaccatcatataaaggaacacttatgcagattttatcttttcaaccggacattgcggaacgtatgctggaaggtacggaaggcgagtcggtcaacgaaaacgcacaattcgtccgtacggacaacggctattggattgcgtggcatgaaggcgtagcggcactgcttgcgcccgatatgccgccgggcattccctgtttttgggtggaaggcgcggaaagccttgaagagttgtgcgtcatggtggaacgcggcgagtttgacgaagtggaagagtttgacggcgatgacgacgaatggctcgaaacggcacagggttgcgggcaccacggcgacgcttgcgcctgcggacattaaaggcattgcaggcttgccgcaaggggggcaaggctttgccgttttttaaataatcggtggattgcatctgtttgcaatgggctgaacgcttccctttgtattttattgaataaaaaaacttatcttggtattataattaaggcagcatcaattattttgggatggcaataaacgcaaagcattgatttgcgccgattgcagacttattatagcaggttgcggcgcggacttaatgggaattgtttatagagcatgatggtctgaaacatcattaattaaaaataccattaatccgatttatatttatttcaatttcaatggaaaaacatcaatgacaatgattttaagcattttaagcctgttttttatcatcagactgttatttttagccgtctctattaaacatgaaaaagccttgattgccaaaggggcgaaacaatacggaaaaaccaattccacgctgcttgcggcagttcatacgctttattatttggcgtgttttgtttgggtatggctttctgacactgcttttaatggcatatccttgattggtacgctgacggtgatggcttcgtttgtgatattgtcattgattattaagcagttgggggagatttggacggttaaaatctatattttaccaaatcatcaaattaatcgttcgtggttgtttaaaacattccgccaccccaattattttttaaacatcatacccgaactgattggcatcgccttattatgtcaagcgtggtatgttttattgattggcctgcccatttatttgctggtcttatttaagcgtatccgacaagaagaacaggcgatggcaacacttttttaacccgtttcatcaattatagcggattaacaaaaaccagtacggcgttgcctcgccttgccgtactggtttttgttaatccgctatattccgccatctctaagatttacagcgatacacgggtaatttaaggaatgcccgaaccgtcattcccgccactttccgtcattcccgcaaaagcgggaatctaggacgcagggttaagaaaacctacatcccgtcattcccgccactttccgtcattcccgcgaaagcgggaatctagaatctcggactttcagataatctttgaatattgctgttgttctaaggtctagattcccgcctgcgcgggaatgacgattcataagtttcccgaaattccaacataatcgaaacctgacagtaaccgtagcaactgaaccgtcattcccacgaaagtgggaatctagaaataaaaagcaacaggcatttatcggaaataactgaaattcaataccgcaaaaatctacccgaaatgatatagcggattaacaaaaatcaggacaaggcggcaaaacgtttggcgacttcgtcccagttgacgatttcccaaaaacctttcaggtagttgggacggctgttgcggtagtcgatgtaataggcgtgttcccacacgtcgcaggtcagcagcggcgtgttttcagtggtcagcggcgtagcggcgttggaagtagaaaccaaatccaatccgccggcaggggtttttaccagccacgcccaaccggagccgaaagtaccggccgcgcaggcattgaacgcttcttggaatttctcgaagctgccccatttcgcgtcgatggcggcggccagttcgccggcaggtttgccttgacctttggacgtgaaacccagccagtagaaggtgtggttccaagtttgtgccgcgttgttgaacacgccgcctgaagattttttcacaatctcttccaaaggcaggttttcaaattcggtgcctttgatttgattgttcaggttggtgatgtaggtttgatggtgtttgccgtagtggaactccaaagtctctttgctcagatgcggggacaatgcgtccagttcataaggcagttgcggcagcttatgttccattttgtactcctgaatattgttttaaatgttgtattttggcagtgttgctgcaaataactcggcagcccgtgtattctacctgttttgcggtgcggaaaccaattaaacctgctttacgctataatagaagattgcaatttcggcacgacagataggatgtaccatgaacgattacgcagccatgccgtctgaagaccgtgaggtcggcgcattgtctctgcccccacactcaatggaggcggaacaatccgttttgggtgggttgatgctggaaaatccggcatgggacaggattgccgatgtggtttccggtgaagacttctaccggcatgaacaccgcctgattttccgatccattgccaaattgattaatgagagccgtcccgccgatgtgattacggttcaggaagatttgcagcggaacgaagaattggaagcggcaggcggattcgaatatctgattacgctggcgcaaaacaccccgtctgccgccaacatccgccgctacgccgaaatcgtgcgcgagcgttccattatgcgccaactcgccgaagtggggacggaaatcgcccgcagcgcatacaatccgcaaggcagggacgcggggcagcttttggacgaggcggaaaacaaagtattccaaatcgccgaaagcaccgccaaatccaagcagggctttttggagatgcccgatttgctgaaagaagtcgtacagcgcatcgatatgctctactcgcgcgacaatcccgatgaagttaccggcgtgccgacggggttcatcgacctcgacaaaaaaacctcgggtctgcaacccggcgacctgattatcgttgccggtcgtccgtctatgggtaagaccgccttttctatcaatatcgccgaacacgttgccgtagaaggcaggctgcccgttgctgttttctcgatggaaatgggcggggcgcaactggtcatgcgtatgctcggctcggtcggacggttggatcaaagcgttttgaaaaccggcaggctcgaagacgaacactggggtcgcctgaacgaagcagtcgtcaaactctccgacgcgcccgtgtacatcgacgagaccccgggtctgaccgcgctcgaactgcgcgcccgtgcccgccgtctcgcccgtcaatttaacaataagcttggattgattgtcatcgactacctgcaactgatggcaggatccggccgttccgacaaccgagcttcggagctgggagagatttcacgttcgctcaaagcgttggcgaaagaattgcaagtccccatcatcgccctgtcgcaattgagccgcacggtcgaatcgcgtaccgacaaacgccccatgatgtccgaccttcgcgagtccggcgcaatcgagcaggatgccgacctgattatgttcatgtaccgcgacgaatactacaaccaggactcacccatgaaaggccttgccgaatgtatcatcggcaaacaccgcaacggtcccgtcggtaaaatcttcctcacatggacgggacaattcaccaaattcgacaatgctgcctatattcccgaggaggcaaagatagaggattaaatggctatataaaaatttattaggcgaaatcaggcaaaatcgtttaaaatcatgctgagagattgccctaaaaaataaaacgcggtcttgaggcatttttgcattcagcccgcatataattgaaaatatagtggattaacaaaaatcaggacaaggcaacgaagccgcagaccgtacaaatagtacggaaccgattcacttggtgcttgagcaccttagagaatcgttctctttgagctaaggcgaggcaacgccgtactggtttgaatttaatccacgatacattaccagttaacgttctattgcttatgtgtacacgaaaacaacaaggtttcacgctaacagagctgctcatcgtgatggtcattgcagccattatggcgatgatagccctccccaatatgagccaatggattgcatcccgccgcattgccagtcacgcggagcggattgccaaccttttgcgtttctccaggggcgaagccgtccggctcaatctccctgtctatatctgtcctgttcaagttaaaaaagacggtacgcccaacaataaatgtgactccggcaagaaggggcagggaatgttggctttcggcgacaaaaacggcaataagggatatgacaatgatacggaggatgttcttctccgcagtgtggtattgaatgatgatatcaatgataagcggattaattatgccttcaaccatatcgctttcggtcagactcagccgaccaccgaccgtgtagtttggacattcaatcaaaacgggacgttcggttatacgaaagaccagcatcttacaaaacaatccagctttttttattctgacggttatatccaaatcgtgttgacagatgcgaaggcggtttctgccgatgaaaagaaattccgttcggcggtggttttgattaacagcagcggcagggtcgaagtttgccctaggggtgatcggcgtactatgtgccagtataaataacagtttcagttttaaaaatgaatatgaagaataatgattgcttccgcctgaaagattcccagtccggtatggcgctgatagaagtcttggttgctatgctcgttctgaccatcggtattttggcactattgtctgtacagttgcggacagtcgcttccgtcagggaggcggagacacaaaccatcgtcagccaaatcacgcaaaacctgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatgagacgtaaaatgctaaacgtaccaaaaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaggtttgttccgcttccaattggatgataagggcaagtggggtaatcctcagttgctcgtgaaaaaggttagacatatgaaagtgcggtatatctatgtttccggctgtcctgaagatgacgatgccggcaaagaggaaacattcaaatatacggataaattcgacagcgcccaaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggatggaatataagaaaggcacgagaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaataaaatggaacaaaaagggtttacattgattgagatgatgatagtcgtcgcgatactcggcattatcagcgtcattgccataccttcttatcaaagttatattgaaaaaggctatcagtcccagctttatacggagatggtcggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataaggttgttttgccaataccgtctgaaaatcaatgttcagacggtatttttatgggtatagtggattaacaaaaatcgggacaaggcgacgaagccgcagacagtacagatagtacggaaccgattcacttggtgcttcagcaccttagagaatcgttctctttgagctaaggcgaggcaacgccgtactggtttttgttaatccactatacatcccgtcattcccacgaaagtgggaatctagaaatttaatgttgcggcactagccaaaaaaaccgaaaccgacaggtctagattcccgcctgcgcgggaatgacgaatccatccgtacggaaacctgcaccacgtcattcccacgaacctgcatcccgtcattcccacgaaagtgggaatctagttttttgagtttcagtcatttccgataaattgccttagcattgaatgtctagattcccgcctgcgcgggaatgacgaacctatccgtacggaaacctgcatcccgtcattcccacgaaagtgggaatctagttttttgagtttcagtcatttccgataaattgccttagcattgaatgtctagattcccgcctgcgcgggaatgacggattttaggttggggtcatttattgggaaaagcagaaaccgctccgccgtcattcccacgaaagtgggaatctagaaatttaatgttgcggcactagccaaaaaaaccgaaaccgaacggactagattcccgcctgcgcgggaatgacgaatccatccatacggaaacctgcatcacgtcattcccacgaacctgcatcccgtcattcccacgaaagtgggaatctagttttttgagtttcagtcatttccgataaattgccttagcattgaatgtctagattcccgcctgcgcgggaatgacggattttaggttggggtcatttattgggaaaagcagaaaccgctccgccgtcattcccaggaaagtgggaatctagaaatttaatgttgcggcactagccaaaaaaaccgaaaccgaacggactagattcccgcctgcgcgggaatgacggattttaggttggggtcatttattggaaaaagcagaaaccgctccgccgtcattcccacgaaagtgggaatccagttttttgagtttcagtcattcccgataaattgccttagcattgaatgtctagattcccgcctgcgcgggaatgacgaacctatccgtacggaaacctgcaccgcgtcattcccacgaaagtgggaatccagttttttgagtttcagtcattttcaataaattgccttagtattgaatgtctagattcccgcctgcgcgggaatgacgaatccatccatacggaaacctgcaccacgtcattcccacgaaagtgggaatccagttttttgagtttcagtcattttcaataaattgccttagcattgaatgtctagattcccgcctgcgcgggaatgacggattttagtttggggggcatttattggaaaaagcagaaaccgctccgccgtcattcccacgaaagtgggaatctagttttttgagtttcagtcattcccgataaattgccttagcattgaatgtctagattcccgcctgcgcgggaatgacgattcatatagtggattaacaaaaatcaggacaaggcggcgaagctgcagacagtacagatagtacggaatcgattcacttggtgcttcagcaccttagagaatcgttttctttgagctaaggcgaggcaacgctgtactggtttttgttaatccactataaaaaggcatattgaatgcgggcaaaccggctgctttccgtttttggatttcggagaatgccatcgcccagctttcatcacacataaaaaacagtgcgggcacggcttttttcagcggtattcctttcaggtgcggggcaagcgccgcccccatcaggatatgccgagaattaatcataaaggttacggtggcgataagcagtatcggcagaggttccgcccacaggttgaccgtggcaaactcggagccgccggcgaagttcatactggtcatcaacaacatttccagccagctcatgcctttttgtccgccctgcataccgagtattaatgcccaaggcagcagcccaatcagcataggcgaactttctttgatgccgcgtataaattcgttatgcggggaaggtgtgcataatgttcgtcttcataaccggaagggcgggaattatacactggcaacggatttcaaaacaaaaccgatttgccgtgtttcagcgtaaacacggcttgtgtataatctcccatctttgaaaccggccgtatgcaggagcaagacgatgaatattgaagtagaaatgaaagtattggacgaacggatggcggatgttgtccctgtctatgcaacggagggttctgcaggtttagatttgcgcgcctgtttggatgaggaagtcgttttgcagccgggtgaaacgtttcttgtgccgacgggtttggcaatttatttggcgaatcccgcatatgccgccgttttgctgccccgttccggcttggggcataaacacggcattgttttgggcaatttggtcggtttgattgactccgattatcaaggggaattgaaggtgtcgttatggaacagaagcagcgaaccgtttactgtcaaaccgtttgagcgtatcgcgcagatggttgtcgtgccaatcgtgcaggcgggcttcaaacgtgtcgaggagtttgtcggaagcagccggggtgagggcggcttcggcagtacgggttctcactaaaaatatagaatgccgtctgaaagacacgtcaggttcagacggcatatcttccgatataccgacaaccggagaaaatcatgaataccttactcaaccaactcaaaccatatccctttgcccgactgcgtgaagcgatgcagggcatttccgcgcccgaaggtctggaagccgtccccctgcacattggcgaaccgaaacatccgacaccgaaagtcattacggatgcgctgaccgcctcattgcacgagttggaaaaatatccgctgacggccggtctgcctgaactgcgtcaggcgtgtgcaaactggttaaaacgccgttacgatggcttgacagtggatgcggataatgaaattctgccggttttaggcagtagggaggcgttgttttcttttgttcaaaccgtgttgaaccctgtttcagacggcatcaaacccgcaattgtcagcccgaatcccttttatcagatttacgaaggtgcgacacttttgggcggcggtgaaatccattttgccaattgccccgcgccgtctttcaaccccgattggcgcagtatttccgaagaggtttggaaacgcaccaaactggtgttcgtctgctcgcccaacaaccccagcggcagcgtgctggatttggacggctggaaagaagtttttgatttacaggataaatatggtttcattattgcctcggatgaatgctattccgaaatctatttcgacggcaacaaacctttgggctgcctgcaagccgctgcacagttgggtcgaagcaggcaaaaactgcttatgttcaccagtttgtccaagcgttccaacgttccgggcctgcgttccggttttgtcgccggcgatgccgaactgcttaaaaactttctgctttacagaacctatcacggcagtgcaatgagtattcccgtgcagcgcgcaagcattgccgcttgggatgatgaacagcacgttatcgacaaccgccgtatgtatcaggaaaaatttgagcgcgttattcccattttgcaacaggtatttgacgttaaattaccggatgcctcgttttacatctggttgaaagtccctgatggcgacgatttggcacttgcacgcaatttatggcaaaaagcggctatccaagtattgcccggacgttttttggcgcgggataccgaacagggcaatcccggggaaggttatgtgcgtatcgctttggttgccgatgtcgcaacttgtgtcaaagctgcggaaaccattgtttccctatatcggtaaagaataaaaaaatgccgtctgaacttttgttcagacggcatttttcaatattttacggttgaatttgctataacggtatttatagtggattaacaaaaatcaggacaaggcgacgaagccgaagacagtacagatagtacggcaaggcgaggcaacgctgtactggtttaaatttaatccactatacttcacttttaatcggcttgcccgcaaacacgtttaaacttaaaatccccgtgtttgacacaataccgagcagattatgttttttgtcctttcccctgcgaagaaccttaatgaaaaagaccctgcccctgtcagcgagtttacccaacccgacctgctggcagagtccgacattctaatgcagcagttgcgcgagcttgcgccgcaacagattgccgaactgatgcacgtttccgacaaaattgccctcttaaacgcgcagcgcaatgcagaatggaacacgccgtttacgccggaaaacgccaaacaggcggtctttatgttcaacggcgatgtttacgaaggtatggatgcaaacacattggatattggacagatacgctatctgcaaaaccatgtccgcctgctgtccggtctgtacggtcttcttcgcccgttagacctgatacagccctatcgtttggaaatggggacggcatttgccaatttgcgcggcaagaatttgtatgagttttggggcgacatcattaccaaccttttaaatgatacgcttgcccaagcaggcagcaatacgcttgtcaaccttgcctcacaggaatatttcaagtccgtcaacacgaaaaaacttcgggcgcggctgattaccccaatatttaaagacgaaaaaaacggtaaatataaaatcatcagtttctatgccaagcgcgcgcgtggattaatggtgcgctatgcggcagaacatcatattaccgaccctgaaatgctgaaaaattttaattacgaaggctacgcattcaatgacgcggcttcaaatgaaagcgaatgggtttttatgcgttcggaacaaataaagtgaaaacaataaattaagtattttccgaaaaaagtgcttggcaaaatgtataaatttcattattattcctaatcttcaagaagacggaagcgtggcagagtggtttaatgcaacggtcttgaaaaccgtcgagggttgatagccctccgtgagttcgaatctcaccgcttccgccaatttttgagcgtaaaaccaaataagaatgcaatagccgcaaatattgtatttttatttggttttactgcattatcggaaacgtggcagagaggctgaatgcagcggactcgaaatccgctgagggtgcaaatcctccgtgggttcgaatcccaccgtttccgccacaaaacaaaaccgccctgattcggggcggttcttttttgttcaagttgtatcaattaccatataaaaatcatcggtttgccctatcataacgcatcaaagcaaatcatttgcaatcttgcggcatcttcttattgcatttttttatggtaatgtgtatggtaatttttggataaatgggaaattaccataatggcgaaaatcattacgccgctgtcggcaaatcaggttaaaaatgcgaagccgcgcgataagctgtataagttgtcagacggggcgggctggctttgtgggtctacccgacgggcgggcggagttggaagctgtcgtttgtgcaggatggaaggcagcagacaatttcgctggggcggtatcctgatttttcgctggccgatgcgcgggaatggcgggaggaggtgcgccgaaaacgggcgcacggggaaaatgtcgtcaataagaaggtgcgggcggattttgcttttgagaaggtggcgcgtgattggtttgtgcgttggtcgaaggggcggtctgaaaagtatgccggacaggttatgcggaattttgagcggtgggtttttccggctatcggcaatcttgatattcgtcaaatcaggacggcggatgtggtcggctgtctgcgtgtgatggaggcgcgcggtatcgttgatacgttgcgcaaaacgaaaaacagtctgaagatggtgtttgcgtttgcggtcggttcgggaatgatggaaatcaaccctgtcgcgcaaatcggttcgggtgtgtttgaacgggcgaaaacggggaatatggcagcgttgagtccgtctgaattgccgcgcctgattgattttttggagcagcgcaatgaatttgcggtttatgcgggcagggtgcgtatccatcctgtaacgcggctttgtatctattggctgctgttgacaatgacgcggattcaggaggcggcgttgatggagtggtcggagttggacggggaggtttggcgtatccccgccgaacggaaaaaggagcggcgggggcatgatgtgccgctgtcgcgggcgatgcagtgggtgttggatcaggcgcgggcgttgaatgtgaacgggcggtttgtgtttgaaagtgtgaattttcaagggcatatcaataaggaaagtccgcgcgtggcgatgcagcgggcggggctggatacgacggcgcacggtttgcgctcgcttgcgcgtacttatttgcgcgaggttctgaaggtggatagtattatgcggaaacgcaaataaaaaaccgtttccgcatttttattggaaggcttttttgcaaccgctttacacaaaggcggttttttgtgtaagaactgctataatagcagcccgtcatcgtcaggagcggctaatgcctttaaaattccaaccaagggaacgttcggttatcatgtgcgactttcgcggttatgaagaaccggaaatggtcaagaaacgccctgtcgtcgtcatagcgcgaaacaggcacaacggcaaactggtaacggtcgtacccttaagcagcacagaacctgtccctttggcggactaccaccacaaaatgagtggaaaccccttaccggacaagccgcacatccaatgttgggcaaaatgcgacatgacggcaacagtcggattggcacgattagaccgatacaaacccaaagggcgcgaccgctgcattccaataatcagtgaagaggattttcaggcgattaaaacagccgttgccaaggcattcaaactgtactagaataaaaccgttcccttaaaggggcttgcaagactgttctgaaatatgggcagccgcgcacgggcgacaggcgatgacaagccgtccgtgcgtgtgatggggcgcggaatgcgccccttgtcgtatctgcaaacgcctacaaatccccaatcagcctttcaatcaaggctgttttggacaaacccgcctttgccgcctcctgttccagtttggctatcgttgtgtccgccttaacgggcgatttaagaaccgctttacacgaaggcggtttttttgtatagtccggttcacgaggtacagaatcttgaaaatagtcaagcaatgccgtatattccgacgcaaggatttattttcaacatcagcttaaggggatgacaatgggacatatttattcggaaagccgtgatttccgcctttcagacggctgggacggcaatgactgacaacctaatacagatagcaacgccgatattgactgttatcggcgtttttgttgccgcttacggcatcatgaggaatacagaaaacgccaaaaagcgcgctgatcatggccgaacgtaacaatgccgcccttcaagaagccataaccatagtaaacgggctggcaaaaacagacggatgcatactcgccacctatacatcggataccccggacaagaagaaagaccgtgaagccatactgacagttttaaaccagcgcgaatttgtctgtgcgggcgtattaggcggagcactgcacgagaaaatgtataaagatttcgaatactccatgctgttacgtgactgggacaacctaagcagctttatttttgaaatacgccgtatcaggagcgcaccgacggcctttcaagaatttgaagccgtagcccgaaaatggaagaaaaagcctctgaaaaccaaatagcttaatagcttaacatccgccgcaacataggccgtctgaaattcagacggcctttcagtttgccgcctacggttttttgggaaaccccttgcatgtgcagggggttttgttttatattcctgttcgtggcgtcagaaaccacactacagcggcaatcactccgtcaatgtgattttttcatgtctatagttttctttccttgttgtttgtttcgatagcaggaagtttctatgaccgcgtgggcgacgaatacaagacccgaaaggggaataagtccgccctcctatgtgggttcttaaccgcgtgtccgcccatttgggctaattctcttgacacatttccataactctatataatatttcccacggtgcttgaaaacacctgacaaacagcgtatatccaacacgatagagtggaattttttacgtctatacgtatcaaatcgatttactcctatgtgggggtgcgcctacccgtaaggctggcggcgcgcctgtttgcgtgttttcaacacccctgcgcccaatttgggcattcctaaatcctacatgctgttgaagaccgcgaccctatccgccacatggcggcttttttatgcttgcagaaaatagaaagattggatatattacgaaacacgaggcgtcgaaaacctctactagaacggcatttaccccgtcagcgtgaattttttacgtccataagttttcttgtttggttgtttgtttcgatatatccgaactagtttcctatggtcgggagggtgcggaatacaatacccgcaaggggaataacgccggccttttctagtaggttttcgaacctcccgaccacccatttgggtctttcgaaactaaactaggaaactatcatgaacgtatctgttctcaattttggtaacacccctgtatctttccgtcaagacggttttttaaatgcaaccgccattgcatctcactttggcaagttacctaaagactacctaaaaagtgaacaaactcaacaatatatctctgcacttgctgagaatttaagcgttaggagaaaaatcctaacggaagcaaatcaaatagttatcgtgaagcgtggtggcagtgagcaaggcacatggctgcatcccaaactcgctattcactttgcccgttggcttaatccgaaatttgcggtttggtgcgatgagcagattgaaattttacttaacggcaaaatttcagacggcataaaaacagttacccccaaacccacccgcgcccttccggacggcttgaccggcgaacaaatcgaagccgtcaaaaaactgcacaacgccctgaccaaatccgcacccaaagaagcgcaggcgcgtatcgccattaccctttggtctgccgtcaaaagcaagttcggatgcagctacaaagaagtacctgccgaacagttccccgaagttttaagcgtgatgggccgcgtggcagttgaaaacggcgtgctgtacggcgaagtcctcgaccgcgaaccattgcccgcaccgcaacctgccctgcccatcagcggcaacgccctgtacgacctcgccgttgccgtcagatacggcgcgtgggccatccaaatgggcagagacgtttccctgccgctgaagcagctcggctgcaaacaggcggtaacgatgtggacggtctgggcggaaacacgcagccgcctcaaagccgccgcaaacgccctcgaagccttaaacgcacacgccgacgcggaacacgcggcaaaaatccgcccgatgctgcccgaaatccgcaacctgtcgtcggtttgatgcagtagggaatacaaaagccgtctgaatgtgaaaacgccctaatcgggcgtttttttattgctgtaaccccagggcttccaaaacttcgcgggtgtcccatacgggggatgtgagtggggttttcagacggcacggtatccgtccgtctttttccatacgcagcagtgtcgagtttgaaatggggcggttgcggcaggttgcgtaggcaatcagttcgcggatggtcgggcggtctatccttgcgcccagttcgttgatgttcatttttttactctcctgtaatgactcggtttctggaagcggcgtaatacggcatcggcggccgtgatgaaaagccataccgccaatgcctcagcgccggaaaatgacagcgcgatgatgatttttaatagggtgtccatcaggctttccttttttctctagtttcgtactcataaatgaacatcgggaacgcctgcccgcttctgacaagatttaaatccggtatctgatcggtaatcagacaagaaaaccgcccgtccccgccgtttcccgtcgaacagcaaatcacaaggttgccgccaaatggaatcgtatcttgattcgtgttcatctttactgctccggcaaatacgttttaaaaatcaaatcttcaagtcggcggtaaaccttcccggtctgcaccaatgactcggtttcgggaagcgcggccaaaagcttccgcatatgaccggcaatcgcctgtaacacaagctgctcgccgcgcgttttgttgtgtttggcaaccatcgccgccagcccgtaaaccgccaagtccatcattgcctccacgctgtcggcttcagcggaatgcaagagattaatctctatgtcattcttgatgttctcgttttcttcctgaaagttcatttttccagctccggcacttccgcgtcgccgtgtatccatcggtagtctttcaattcttcggcttcgcgttgtctgatttcggcgtcgatttgggcgttcaacccgtcaatctctgcctgtttgtcggcgacggctaagcgcatagcggtcaggctgttttcagccttgacttgcactgcggcttcggattgcggttggcaggcgtagatgccggcggctgcgactgcgagtaaggcggtgcggatcaagtatttcattttgattcctcattattggggtaacggcttaatatcaggcagcgtttttgaggttgtcttttgtcagacagatgagcgcctttctgacggcggcaaagggggttttgtactctggctctatgccgacaagtagctccccgtctgtgttgatgatgtcgcatccgtagcgttcggtggggtagccgtagtcgtttttcccctgttctgaggttactcggatgtcgatggagtattcttctgtgatggtcattttggggtctttcggatttgggtttttgtggaggtcgtctgaaggttcacgatttcagacgacttttttttaggcgattacgccgaaatagatgtcgatttcagggaaggctttttgtacggcttcggaaatgtcttttgccgcttgttcgattacagcatcgatttgctgcaattcgtaccacaggacgagtgcgccgctgtttttgtcgatgcggaatttcaacagggcttcaacaaagtaggatgcaccgccttgatgcggggtgaactcgatgccgaaacgttcaaacattttgaggtttttctctgtttgccctgagtcttcggattggaaggtaaagttgattctgccgtcctgttcacgatagccttgtttgaaggtggttttttcggtgtactcgagattgagcgcgaaatccaatacttcggcggcggtcgggtaaacggaattttcgttaccgggatttttggatacgatgttgcgggcattgttggtcaggaaatgggaaaactccatctgattcatgcggtgcgcattgttgttcagccagttggatgccgatgtagtgtgttgcggggtgtatacggcataaaaatcgagccagcccggagcttgttgcgtatggccattgatgacggcggtgacatcaatacgccctgatttgaaatcggcatcaatgtagatttgtgtgccgtcctgtttgtgtttttgtacaaacttaataagactggcggtatcgtgcatgaggaatttgccgcacttgcggtacgggttttgcatcaattcggggtgtgatttgtatctccagccaccgtcttggtctggtgtgaatacaagcggagtattgttcggtgcaaactcaaaaaaaggtttttgagctgcttgtaaggcggttttaatcatgttttcttgggtttccattttagatttccttttgtgtttgagttagttggatctgaccattttcaacgtgcttgacgtattggaaacttgtttgagtttcaattttccttgtgccggatcgtcggcttggatgttgccgtcaggtgtagcaaagacgatgccgccttcgcgtttttctttgggcagtttggttgctacatcgtggctgatttttaccgttccgctttggatgttttggggttggattttgagcttgacagtaatttctgactgtttaccgtgagcaaggcaggcacgcaccgcttcactcatggcttcgcctaattcacggtctaaccagccgctatttacggtcggtatttgcttggaggcaggaacaaatttcttttcttgggtttccatttttgattttcctttaaagagaggttagttaggttgccggtatcacgggatgacaataccgaggaggttatttaattttgagaatttccaaagattccacggtggagcgggctattccaaactcgttaagtgcggcaaagccggctgctggtatggtggatgctccgtaatttatttttggaataaaattttcgttcagggcgacggcggttcttgcgagatttagcaaagcgtcgaaattttctttagggatggtgatggtttccatgtcggtactccatgtggctgttgtttgtttcgatgggtgtatttaaacatagcgtttaataatatgcaacaatctgtttaagatttttgtttaaggtttataaacattttgattattaaaagaatttatttttgagatttcgcaggcgcaaaaaaaccgcctattaaggcggctttgtcggttttgtgttgttttcaggttcggcggggcatgaaaaaagcccgcataatgcgggcgggttgtttaatctgtggggtcgtatgccacatcaactatcagcttcgttttccttaggtgttggttgatagcataaatttcgtgccatgccttgcttagataatactgccgaagcatcgggattttagatagccggtgtggcattgggatatttcgtgcgcaccatagccgcaacagagtgtcttcgtcatcgatttggatatgttttaagattaagccgcttgaaccgacgggcaatagataccttgcgtcagggttggcaaaatgcttaccggaaccatcaaagtcatacaatacatttggcttgaggtctttgtagttctcttttctgcgcggcgcagatacttcgccaagccactcaaagcacagggttgctgttctgtgatgcagctcgtgaaccttcaactctccttgtacgccaaggaaattcataccggcatcgtactcaccaggccaccaaggggaatcaaaacgcctatttttgacaatcttgaaagccctatcaatattatctcgtcgtaatagcaacatttttcaatccagcacgctccaccaaaataccctgccgataacggtcaggctgtccaagggggcgttttcgtcgccatagaaaccgctgttgtggctgcgtatcagaacgctgttgccaggctgccgtatcaggtacttcacgcggaacataccgtcctgggcgaaggcgtagattttgccgtcgcgtatggcggtttcgcccgtatctacggcaattgccgcgtcttctgcgattttttcctccatactgtcgccggtcagggtgcagcaaaacacgttgtcgggattgatgcctttgcgtttaagcgtggatttgccgaacggcaggcggtagccgttgtaatcggggatttcatacgtgcctactccgcctttgaagcagctctctttgaggtaggggacgaaaacataatcatcgtcgggcagcgggtcgttgctgctccacgtcatcgggcggtggatgtctttgacttcgtggggtaggtcggggtcaataaggacgggcgcggttcggctgccttcacctgttctcagccatgtttcagatacaccgaatgcttttgctacttcaggcagcgcctttgccgctatgccacgactttcccagtttttcaaagcctgttggctgatattcagacgctctgctatgtcagccggctttaaaactccctgctctttggctatctcaaaaagtctgtcagttgtctcgtgcattgtcatttttaatcttattcgcggttggcttaattattctcccatatttaaacaaaatgttgttacacaagacttgatttttatctaaacatagtgtttaatattagcattagatttaaacatttggtttatttatggataaaagagtcaatgaagacaaacgcctgttgcaatcaatcggcagttacgcggaagttggtcgaataacagggaatagccctcaatgcgttttcaattggacgaagcgcgggatacctgcacgaataaaacttaagtatcccgacctgtttttgaactcaaagaaaccagacgaccaacccaaataaaaaaagcctgtcgtggaaagctcgccgcgggctggggaagccgcattgatgacgataatttttaatattgcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgtcctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcgcaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttaagctgtttggcgatttcggtgacggtgcagtggcgggacaggtattggatgtggtatcgttcgccttgggtcagttgcgtgtggctcatggcaatctttcttgcaggaaaggccgtatgctaccgcatactggcctttttctgttagggaaagttgcacttcaaatgcgaatccgccgtgcgctgaaattcgaccagttgatactcgaatttcctgagcgcggggacggcgcatgggtacacatcggtttccgacgcaacagcccgcaacgcaaccagatactgaccgcaaccaagaaaaacggcaaaaccgtgtatctgcccgggctgcatccttgaggtcgtctgaaatggatattttattgaaatactggaagccggtaggtgtattgctgctaatcgtcctgatttttaccgcatggcatttcgaccgtgccgaaaaataccgcatgggacgggaggctgctgctgccgaaatctcgaatcgtctgaaagacggctatatcgagcaggcaaagcaggcgcgttctgccgagcagaaggccgctgccgcgtttgccgaacgacaaaccaaattagaagaggaaaaacaaaatgctgaaaaaactgttgccgctatgcgtcttgagcttaaccgcctgcgccactacgccgccgcccaaaatcgcaacagaaacctgcccgcaaccgctaccgccgccaccgcatctgatggcgcgtcagattcccaaggctggctattattcggacagtgcgctgaaaaatatgcaggactggcagaaacagccgacggacatgcagccgatttaagggaatggcaggcatatggtcatgcagtaagcagtcagcgtgccgaataagcaaccgcccgaacctgtaagaaaagattacaggttcgggcggtttcagcatttaatcgaataagacggcgccgatgcgcgccagcacatcgtccaatacataatcgggtacagtttctttaaaagaagccttgcggatttgccagtctagagatttgagctggtggcagtggacattgccctgcgtttccgttcctgcaccgagtaaggttgaaatcatgccgctgcttcgtgcagctgctgcattcccctgtgaaatggggcaggcaaaaaccaatcccgttgcgcggttgaatgcttttggagacagagccagcgcaaaccgcccgcccttgatttccttgccgctggaagggtcgaaattcaaatggaaaatatcgcctttgtcgggaatatacatttcagacgacctcgttgccggcatcatccaagatttcccagccttctacgcgcggcggggtttcttccatttcggcaagcaagtctgccaagcggaaacgtcgggcagcacgcacacggagttcgccgttatgtacttccgctaccaaagcgtcgccgattttaaaatccaattgtttcagcatgtcggcaggcagtcggacggccgccgagttcccccatttttggacacgcaacataatcttcacctttattgtatctacaaagtagatacatattaccataaaatttcagttgttcaaatacttgtgcagaatacgccaaaagccgtccgaactgtttcggacggcttttgtactgtatttgcgccttcaggcaatattttgttatccattttcaagatgcaaaagctttctaattgcttgatgtcggatttcggttgtttagggatacaaaaccaagtaaactaaaactgtttgattggaaaatgctccgcaaggagaaaattatgttcaaaaaatcactttataaggctgctttggcgtatttcggcgattgcgtggctgcccatatttcagaacagttttgactgtttattcacaaatcagatgcctttagggggtttgctttccataatgcaaccaaaatttccaactctctaaatattgtgtctttgcgttcttcttcgcgtattttcataacaagaggcgaaactgcattccacaattttatgaagttggtgcaatgcagccgtttaaacaaatcctcatccaatactcccgagttgattgcgcacgcataaaactcgtgccgattgattacggtaagtaaatgccctctctctttttcccattgtccgcccttattttgataaatttcatacaggtcgatccgcgcgttgttgtcgtcaactgccgtgccgcgaatataaggcgaaatatgattgtcggcttctacaaattgtgcatcttggtaatcattcaaaataacatctaatgtcgccttttgctttgaagttttcttattgatgaatattgtccccagtgcaatgacggcggttactgaaacaacggtcagttgccaaaacatcagccattcggccgtccctcataggttaaactgtacgctgtgcctgaatatgtaaaataaagtgaatacagatacaaacaaggaggttagggcaattactgacaaccaacctccttgttttatttgtttccgcaccttaccagccattaaaaccctcatttttgtatttcatcgtatttccttaatggttttaaccttgcttgtcgatatctgtatattaatgccgtgcgcccgttctttcaaggggtgatttaaaaatcaggcatccttgacatcctctcctgcttaaaggcggggggactcctgccgtgtaaaccaatgccgtctgaagggctttcagacggcataaaaaaaccgcctttgtgtaaagcggttgaagaaaagcctttcaataaaaatgccgtctgaatttcagacggcattgttgtcggatatgcctattccttatccagccggcgcagggtttcggcgagctgtttgaagtcggtttctcccgccgccaaactgacaatcaagtcgtcaagcccttggtcggcggcaatgctgatgccctgcaaatccagataggtcaacattgttaaaagcgcggtgcgcttgttgccgtcgggaaaggcgtgggctttggctatggcttgtgcatagagggcggcgatttcgtagatgtcctcaaggttttcatactgccgccagttggcaatccgcgacaatgcgccgtccaagcgcgccatatccgcccgccctttcaaacccgcttcatccgccaatacggtttgatggataagcgcgaccagttcgccgtctatcatttgtcggcaagtgccttgacggctttttgatgggttttggcaatgcggcgggcggcggcaagcagtacgcgtttgcctgcttcgcctttaagctcgattttgacggggcgtgtattttggttttgcatcgctgctccttgtctgtttgcgggcattttagcttttttccggcagcttgggaaatgccgtccgaaaacacttcagacggcattcttctaatagtgtaatgcaatagttactccaagatttttgtatatggctgtttttatggtaaattaaattttcataagaaataaatatatttaaatcaatgaaataaaatttagtcgaatcccaccgtttccgccacaaagcaaaaccgccctgattcggggcggttcttttttgttcaagttgagacctttgcaaaattcctttccctcccgacagccgaaacccaaacacaggttttcagctgttttcgccccaaatacctcctaattttacccaaatacccccttaatcctccccggatacccgataatcaggcatccgggctgccttttaggcggcagcgggcgcaaatcagtccgaaataggccgcccgggcgtagcggaatttacggtgcagcgtaccgaagctttgttcgaccacataacgggtcttagataaataccggttgcgtttggtttgcgtttccgtcagcggacggttgcggcaggctttgcgcataatgccgtcctgcaactgatgttcttccagatgttgccggttttccgcactgtcgtagcctttgtcggcatagatggtcgtaccttcgggtaacccttccaacaacggcgacaggtgtttgcactcatgggcattggcgggagtaatgtgcagtttctcgatatagccttccgcatcggtacgtgtatgttgtttgtaaccgagtttgtagaggctgtttttctttgtccaacgggcatttttgtccttactcagtgtggtttgaccgctgacttgtccctcttcatcgacttctatggcctggcgctgtttgctgccgacggtctgaataatggtggcgtcaacgacggcggcggatgctttctctacttttaagcctttttcggtcagttggcggttaatcagttccaacagttcggacagggtgtcgtcttgcgccagccggttgcggtagcggcataaggtgctgtaatcggggatgctcagttcgtcaaaacggcaaaacaggttgaagtcgatgcgggtgatgaggctgtgttcgagttcgggatcggagaggttgtgccattgtccgagcaggacggctttgaacatggacaacaggggacaggcgggacgaccgcggtggtctcggaggtaacgggttttttgacggttcaggtattgttcgatcggctgccaatcaatcacctggtccaacttcaatagcgggaagcggtcgatgtgtttggcaatcatggcttgggcggtttgttgaaagaaggtgctcatgagaaatcccctaaatgtcttggtgggaatttaggggattttggggaattttgcaaaggtctcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaagacgacgaagccgcagaaagtacagatagtacggaaccgattcacttggtgcttcagcaccttagagaatcgttctcttcgaactaaggcgagacaacgccgtaccggtttttgttcatccactataacagcaaccctgtcgccgtcattcccgcaaaagagggaatccagtccgttcagtttcggtcatttccgataaattcctgttgcttttcatttctagattcccgcttttgcgggaatgatgacggaagggttttggttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcctgcgcgggaatgacgaatccatccgcacggaaacctgcaccacgtcattcctacgaacctacatcctgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgccgtactggttttttatatccaatgggtgcggcgtttaatcataatcaggcagatagggataactaatgccgtctgaacgacgaatgttcagacggcatttttacctttgtgcttataaggcgtttagtgcctgattaaaggttacgctcggacgcatcacttgtgcggctttttcaggattggcggcgtagtagccgccgatgtcggccgctttgccttgtacggcggaaagctcggcaacgattttcgcttcgtcggcggtcaaagcggctgccaatggcgtaaatgcggctttcagttcggcatctttgtcttgcgccgccaattcttgcgcccagtagagggtgaggtagaaatggctgccgcggttgtcgagttcgccggctttacgtttaggcgatttgtcgttcaacagcagtttttcggtggctgcatccaaagtgtcggcgaggacttgggctttggcattgccggttttttgcgccaaatgttcaaacgatacggcgagtgcgaggaattcgcccagcgagtcccagcgcaaatggttttcttcgaggaattgttgaacatgtttcggtgcagaaccgcccgcgccggtttcaaacataccgccgccgttcatcaatggaacgatagacagcattttcgcgcttgtgccgagttccaaaattgggaacaagtcggtcaggtagtcgcgcaagacattaccggttacggagatggtgtcttcgccgtttttcagacgacccaagctgaacttggcggcttcttcaggagcgaggacgcggatgtcgaggccattggtatccagttcggcaaggtaggctttaaccttggcgagcaggctcttgtcgtgcggacggttttcgtcgagccagaacacggcaggcgtgttgctcagacgggcgcggttgacggcaagttgtacccagtctttaaccggagcgtctttggtttggcacatacgccagatgtcgccggcttcaacgtcgtgctgcattaggacttttcctgccgcatcaatgacttggacttggccgtcggcttcgatttcaaaggttttgttgtgcgagccgtattcttccgccgcttgcgccatcagtccgacgttgggcacagtacccatggttgtcgggtcaaatgcgccgtgttcgcggcagaagtcgatggttgcttggtaaacgccggcatagctgctgtcgggaatcacggctttggtgtcttgcgctttgccgtttttgtcccacatacggccggaattgcgaatcatcgcaggcatagaggcatcgacgatgacatcgctgggaacgtgcaggttggtgatgcctttgtcggaatcaaccatcgccaaatcggggttggcagcgtaaacggcggcgatttcggcttcgacggcggtgcgggtgtccgcatccagtttgtccagattggcaagcaggttgccgaagccgttgttaacgttgacgccggcagcagccagtttgtcgccgaatttttcaaaaacaggcgcgaagaatactttgacggcgtgtccgaagataatcgggtcggacactttcatcatagtggctttcatgtgcagcgagaacaacacgccttttgctttcgcatcttttacttgttcggcaaggaaggcgagcagggcttttttactcatcacggtcgcgtcgatgatttcgccggctttcagggcgacgggctcgcgcagctcttttttgttgccttgtttgtcggtgaatacgatggatacggaagtcgcttcaggtacgataacagattgttcgttatgaaaaaagtcgccgctttgcatggtggcaacgtgggttttggagtctttggtccatgcgcccatgctgtgcggattttttttcgcaaagtttttcactgctttaggggcgcgacggtcggagttgccttcacgcaggacagggtttaccgcgctgcctttgatgcggtcgtagcgttcgcgtacggctttttcttcatcggtttgcgggtcggcgggatagtcgggaacggcaaagcctttagattgcaattctttaatcgcggcagtcagttgcggtacggacgcgctgatgttcggcagtttgattacgtttgcatcgggttgtttcaccagttcgcccaattcggcaagcgcatcaggtacgcgttgcgcttcggtcaggtattcgggaaacgccgccaaaatacggccggagagagaaatgtcgctggttttgacatcaatatcggcgtggcgggcaaaagcctgcacaatcggcagcagcgattgggtcgccagcgcgggtgcttcgtcggtatgggtataaacaatggtggatttttgagtcataggattattctcttgtaggttggttttttcttttggaacacattgcgcggggaatgtgcgtggctattatggcatattttggcggctttgttcgcgctttgttcgatcttggcgtgtttgaacgcggcggcgtgaaaggaagggggaaatggttttcccgcgtttggcggcggtcggaggtgctgtgcctgatgtgcggcggcatattttcggtgaaattgattttatagtggtttaaatttaaaccagtacagcgttgcctcgccttgtcgtactgcttgtactgtctgcggcttcgtcgccttgtcctgatttaaatttaaaccactataatattcggtaactgtcggaatatctgctaaaattccgcatttttccgtcccgggacactcggggcgtatgttcaatttgtcggaatggagttttagggatatgggcttgaaaaaggcttgtttgaccgtgttgtgtttgattgttttttgtttcgggatattttatacatttgaccgggtaaatcagggggaaaggaatgcggtttccctgctgaaggagaaacttttcaatgaagagggggaaccggtcaatctgattttctgttataccatattgcagatgaaggtggcggaaaggattatggcgcagcatccgggcgagcggttttatgtggtgctgatgtctgaaaacaggaatgaaaaatacgattattatttcaatcagataaaggataaggcggagcgggcgtactttttccacctgccctacggtttgaacaaatcgtttaatttcattccgacgatggcggagctgaaggtaaagtcgatgctgctgccgaaagtcaagcggatttatttggcaagtttggaaaaagtcagcattgccgcctttttgagcacttacccggatgcggaaatcaaaacctttgacgacgggacaggcaatttaattcaaagcagcagctatttgggcgatgagttttctgtaaacgggacgatcaagcggaattttgcccggatgatgatcggagattggagcatcgccaaaacccgcaatgcttccgacgagcattacacgatattcaagggtttgaaaaacattatggacgacggccgccgcaagatgacttacctgccgctgttcgatgcgtccgaactgaagacgggggacgaaacgggcggcacggtgcggatacttttgggttcgcccgacaaagagatgaaggaaatttcggaaaaggcggcaaaaaacttcaaaatacaatatgtcgcgccgcatccccgccaaacctacgggctttccggcgtaaccacattaaattcgccctatgtcatcgaagactatattttgcgcgagattaagaaaaacccgcatacgaggtatgaaatttatacctttttcagcggcgcggcgttgacgatgaaggattttcccaatgtgcacgtttacgcattgaaaccggcttcccttccggaagattattggctcaagccggtgtatgccctgtttacccaatccggcatcccgattttgacatttgacgataaaaattaatcgcatagcaaatcaaaatagaaaatggcggagtgcgtggggtaaaaataaggatagcgttttttcatttggattgacgataatttctgattgctttgcgtgtgctgaaatggcaaagaaaatgccgtctgaagtcttcagacggcattgttttgttttggatgttattcgggcgcgcggaaactgtcgtggcaggatttgcagcttgcgccggtttcgccgtaggcggctttgatttcgtccagtttgccggtttgggcggcggcgttgagtttttcgacggcggcggcgaattttgttttttcggcttcaaattttgcaccatccgaccaaacggcgggcagtgcgcggccgttgccttgcggatcggactcaaaaagtgtgaacggtttcttgctgctttcggcaaacgacgctgccgcctgtttgaatttttcgacatcgtaaggttcttcgtctttgaccattttgcccatgcgtgtgaattcgggcatcatggatttgaacgcggcggtgcggttttcggaaatttcgcctttgggttgggaaggtattccgctgcctccgcaggcggaaaggagcagtgtgatggcggcagcagcaaggctgatttgggttttcatattgaatgtgtcctgtcgtggtggtatggttgttgtcattttcagtcggcgcgatgccgtctgaagggtgttatgatacctgaaacaggtttgggaaacgagaaagaaaggaaaaacaatggctgttttaattaccggtgcttcggcaggattcggcgaagcgatgtgccgtgcgtttgtcggggcgggataccgcgttatcggtgcggcgcgccgtgcggacaggcttcaggccttggcggatgaattgggtgctttgttttaccctttggaaatggacgtgtcgcgacgcgagtcggtggaaaacgccttaaacggcatccccgatgaattttccgacatcgactgcctcatcaacaatgccgggctggctttgggtctggacacggcggacaaggcggattttgaagattgggaaacgatgattcaaaccaatgttttgggtttgacgttcctgacgcgcaaaattttgccgcaaatggtggaacgcggcggcggttatgtgatgaatttgggttcgattgcaggcaattatgcttatgccggcagcaacgtttacggggcgaccaaggcgtttgtgcgccagttcagcctgaatttgcgcgcggagttggcggataagaacatccgcgttaccaatatcgagccgggtttgtgcggcaatacggagttttccaatgtgcgcttcaaaggcgatgacgagagggcggcgggcgtgtatgagggtgtggaatttatccgccccgaagatattgcggaaaccgcattgtggctgtaccagcggccggcgcatatgaatgtgaacacgattgaaattatgcccgtggcgcagacttttgcaggaatgaaagtgataaaaaaagccgtgcccgaagtgcgggaagactttgaaaaacagagtatgtcgctgttttcccgcatcaggtcctggttcaaatgatgcaaaatgccgtctgaagacagtttcagacggcatttttacgggtatttttacggagtaggcaataagcccgccaatttggggttgccttctttcggaatcgggcgcggattgccttccgcatcgatggcaacataagtgaacacggcttcggttacgaggtagcggtcttcggtaacgcaatcgttcatcaaagttttcacccagacgtcgactttaagctggagggaagtgttgcccacgcggacgcaatgcccgtagcagcagacgacgttgccgaccttgaccgggcggatgaagttcatttcctgaacggcgacggtaacgatgcgtccccgcgcgatttccgccgccaatatgccgccgcccaaatccatctgcgacataatccagccgccgaaaatgtcttggttgggattggtatcgcgcggcatagcgacggtacgcaggagcagttcgccttgagggcgttggcggttgccttcttcgtgctgcataaagtttccttgttttattgaaatataaatcgaacctgcacccctgcccgaaacgggaagtcgggaagtgtgtagtttaacccatttgagacatacaagggcgggcgcggaacagattcgcaaggcgtattgtagggcggggctgtagagtgggcttcagtccgccaatcccgccaaatcctaccctaagcaactgaaccgtcattcccacgaaagtgggaatctagaacgcggggtttcagtcatttccgatagattcccgccgcgtcgggggtctggattcccgcctgcgcgggaatgacgaatccatccatacggaaacctgcaccacgtcattcccacggaagtgggaatctagaatctcggggtttcagtcatttccgatagattcccgccgcgtcggaggtctggattcccgcctgcgcgggaatgacgggttttaagattacggtgttgtcggacggatttcaagattacggtgttgtcggaacgcaactgaaccgtcattcccacgaaagtgggaatctagaatctcggggtttcagtcatttccgatagattcccgccgcgtcgggggtttggattcccgcctgcgcgggaatgacgaatccatccatacggaacctgcaccacgtcattcccacgaaagtgggaatctagaacgcggggtttgggcaactgtttttatccgataagtttctgtgcggacaggtctggattcccgcctgtgcgggaatgacgaatttcaagattgcggtgttgtcggacgggttttgagattacggtgttgtcggagcgcaactgaaccgtcattcccacggaagtgggaatctagaacgcggggtttcagtcatttccgatagattcccgccgcgtcaggggtctggattcccgcctgcgcgggaatgacgaatccatccatacggaaacctgcaccacgtcattcccacggaagtgggaatctagaatctcgggggtttcagtcatttccgatagattcccgccgcgtcagggggctggattcccgcctgcgcgggaatgacgaatttcgagattacggtgttgtcgggaatgacgaatccatccatacggaaacctgcaccacgtcattcccacggaagtgggaatctagaacgcggggtttcagtcatttccgatagattcccgccgcgtcgggggtctggattcccgcctgcgcgggaatgacgaatccatccatacggaaacctgcaccacgtcattcccacggaagtgggaatctagaatctcggggtttcagtcatttccgatagattcccgccgcgtcggaggtctggattcccgcctgcgcgggaatgacgggtttcgagattgcgttgttgtcgggaatgcaactgaaccgtcattcccacggaagtgggaatctaggacgtaaaatctaaagaaaccgttttatccgataagtttctgtgcggacaggtctggattcccgcctgcgcgggaatgacgggtttcgagattacggtgtatcgggaatgatgggaaacggtgggaattgtgtaaaaaatgccgtctgaaggttcagacggcatcggtatcggggaatcagaagcggtagcgcatgcccaatgagacttcgtgggttttgaatcgggtgttttccaagcgtccccagttgtggtaacggtatccggtgtccaaggtcagcttgggcgtgatgtcgaaaccgacaccggcgatgacaccaagacccacgctgctgatgctgtggctttcgtgatagggaggtttgctgggatcagtttgtataataggacctccctgtgcagcgccttgcgttggtttagaggtaacaatcgtggttttggtttccaccgaatgaacttgatgtttaacgtgtccgtaggcgacgcgcgcgccgatatagggtttgaatttatcgttgagtttgaaatcgtaaatggcggataagccgagagaagaagaggcgtggaagctgccgtttccctgatgttttgtttgggtttctttgtagttgttgtttatctcttcagtaacttttttagtagaagaattactttctttccattttctgtaactggcataatctgccgctattctccagccgccgaaatcatagccgaccgacacccgggggtggatggaatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaagagaagagaagagaaggttttttgggggctggattcattttcgactccgtattcggttttaactgattaaaaagaacaattttcaatgatgttgcaggagcggactatatcaggtttgtggcgatgtttcaacacaatatagcggatgaacaaaaaagagaacgattctctaaggtgctgaagcaccgagtgaatcggttccgtactatctgtactgtctgcggcttcgtcgccttgtcctgatttttgttaatccactataaagaccgtcgggcatctgcagccgtcattcccgcgaaagtgggaatctagaaatgaaaagcagcaggaatttatcggaaacgaccgaaaccgaacggactggattcccgcctgcgcgggaatgacgggattttaggtttctgattttggttttctgtttttgagggaatgacgggatgtaggttcttaggaatgacgtggtgcaggtttccgtgcggatggattcgtcattcccgcgcaggcgggaatctagaccttagaacaacagcaatattcaaagattatctgaaagtctgagattctagattcccactttcgtgggaatgacggttcagttgctacggttactgtcaggtttcgtttatgttggaatttcgggaaacttatgaatcgtcattcccgcgcaggcgggaatctagaccttagaacaacagcaatattcaaagattatctgaaagtccgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtttttgagggaatgacgggattttaggtttctgattttggttttctgtccttgtgggaatgacgggatgtaggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagtctgttcggtttcagttatttccgataaatgcctgttgcttttcatttctagattcccgcttttgcgggaatgacggcgacagggttgctgttatagtggattaacaaaaaccagtacggcgttgcctcgccttagctcaaagagaatgattctctaaggtgcttaagcacgagtgaatcggttccgtactatccgtactgtctgcggctcgccgccttgtcctgatttttgttaattcactatatcgcgatttttcggcatttgcctttcggggcggcttgtgtctcgtgcgtgatgttgcgtgtgggaatgttcggattgtcagaagcaatatgggagaagatgatgtatgagataaaacagccttttcatagcggatacttgcaggtgtctgaaattcatcaaatttattgggaggaatcgggcaatcccgacggtgtgccggttatttttttacatggcgggccgggcgcgggggcttcgcctgaatgtcggggttttttcaatcccgatgtgttccgcatcgtcatcatcgaccagcgcggttgcggacgttcgcgcccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcctgaacgggtaaagggattggtgttgcgcgggatatttttgtgcaggccgtctgaaacggtgtggctgaacgaggcgggcggtgtgagccggatttatccggaacaatggcaaaaatttgtcgcgccgattgctgaaaatcggcggaaccggctgattgaggcgtatcacggattgctgtttcatcaagatgaagaagtgtgcctgtctgccgcgaaggcttgggcggattgggaaagctatctgatccgtttcgagccggaggaagtggatgaagatgcttatgcctcgctggcaatcgcgcgtttggaaaaccattattttgtcaacggcggttggttgcagggcgatagggcgattttgaacaatatcggcaaaatacggcatatcccgactattatcgtacaggggcggtatgatttgtgtacgccgatgcagagtgcgtgggcgctgtcgaaagcctttcccgaagcggaattgagggtggttcaggcagggcatcgtgcgttcgatccgcctttggtggatgcgttggttcaggcagttgaggatattttgccccatttgttgtaaaaagttccgcataaaaaagcagcttctgtttggaagctgcttttgttttgaatggtttaacgcagttcggaatggagtttgcccaataatgcggatgcgtctttgccggcatatgcgctgccgtctttgttgagcaggacgatgcgcgagccgttggcgacaggttctgcatagacaatcagttccggctgttcggcaggtttctccgctttgcctttgcccagcaggcgtttgaacaggccgggtttttgttcggtaactgcattgctttcgttcggggctttttgaaccaggaaggcgtggcgttcggtgttttgaccgacgacggtcagcccgatgcggtcgagggcgagcacggtgcgccgccagtttctgccgtagtcgccaaagacaatcaggcttttgccttcgatacgcgccatttcgttggcggcgggaagggtaggtttttttgccgatgcgttttccgcctgctgtccgtcaacgcccaaatattgcataaagcgcgtcaggaaagcggcttcgaggttgggatcggacggggagggctgccatacggtcgtgtctttgtctttgccgccgtacacttctttcatggctttgtgggcgaagaagatgtcggaaacgccgtttttgccctgttcgatacggacgatgaatttgtcgcgctcgccggtggagtagatgccgcccaagccgactttgtcgaagaggcggcgcaagctgtcttgggggattttggcgcggttttccgcccactcggtttccatttgtccgatggcgggttcttcggatttgatgtcgaagccgttttcctgccaaaaggctttcaggagcggccagatttcggcaggagacttgccgtcgacaacgagccagcgttggctgccgtcgcgctcgaggcggacacctttgacgcttttcaatacttcggcatcggcaggctgttggacggcgggtgtgcggcgtttttccaaatcgctggcgcggacggcgcccgaaccggcaggcaggcggtagaggttgccttggtcggggttgttcaaatcaggtgggacttcaagtttgatcaggcggtgcgaccggctttggtagtcgagcttgggctgttcggttttgctgccggagcaggcggcaagcccgatgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcttgtccgttttccgtcagcggaacgagcggcaggcggacgtgcggttcgcatctgcccagggcggataccgcccatttcggtgcggcggggctgggttcgcagaacatggtgtcgtaaatcggaatcagtcggtcgttgagttcgcgtgcaagggcgatatcgccttgaagcgcggcgcggcacatatcggcaaagagcttgggcgcggcgttggcggctacggtaatcacgccgtgtccgccgcagagcatgaacggcagggcggtgtggtcgtcgccggaaaggacgacgaagccttcgggcgcgcggttgatgagttcgatgttgctgccgatgttgccgctggcttctttcacgccgacgatgttggggatttcggcaaggcgcaggatagtgtcgttagtcatgctgacgacggtacggccgggcacgttgtagataatcatcggaatcgaagtggcttcggcgatggttttgaaatgttggtaaatgccttcttgggagggcttgttgtaataggggacgacggagagggtgtagtccgccccggctttttcggcggcttgggaaagggcgatggcttcgacggtgttgtttgcccctgtgccggcgatgacggggacgcgtttggcaacgtgtttgacgacggcttcgatgacggcggtgtgttcttcgacggagagggtggcggattcgcctgtcgtgccgacggcaacgatgccgtccgtgccgttttcaatgtgccagtcgattaagtcgcggagttgttcgtaatggatgctgccgtcttgattcatcggggtaatcagggcaaccaagctaccttgtaacatacagaaccttttatcagttgtggtgtaggggcggtaatgcttccgattgtagcctactttaccgcaggtgtgaaatccggcgggttgcagatgtggggcgtttgcgccgaaaggtatggtggaaattgatttttcctgtttgaaatcattttattatattcgccggtttatgccggtgccgtcggatttatagtggattaacaaaaaccagtacggtgttgcctcgccttagctcaaagagaacgattctctaaggtgctgaagcaccaagtgaatcggttccgtactatttgtactgtctgcggcttcgccgccttgtcctgatttttgttaatccactataaaatgtggtaaacgtgtggaccagacggatgccgtctgaaatgcaaattgaagccgtgcggcagattcgctacaatccgcgcttggatttttcaacctttaaaataaggaaatacaatgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactgattttgaaaatgaatgccgtctgaaacagaatccctgtttcagacggcattgtttttgaggcttatactttttcgttttttaatacgcgttgtcggcgtgtttcacttaataccattccggcagacacggagacgttcatgctttcgactgtgccgaacatgggtatagacaccagcatgtcgcaatgttcgcgcgtgaggcggcgcataccgtcgccttcgttgcccattacccacgccgcgctgtcgggcagattgcaatggtaaaggtcggactcgccgctcatatcggtgccgataatccaaatgccgtattctttcaattcgcgcagggtgcgggcgaggttggttacggtgatataggggacggtttccgccgcaccgcaggcgactttgctgacggtggcgttcagccccgcgcttttgtctttcggtgcgatgacggcgtgtacgcccattgcgtcggcggtacgcaggcacgcgccgaggttgtgcggatcggtgatgccgtcgagtatcagcagcagcggcggttcgctgaggttttccaatacgtcttcgaggtggacgtggtttttggaggcatcgataaatccgaccacgccctgatggcgcgcgcctttgctgatggcgttgaggcggtcggcatcggcaaaatatacgcggatgttttcgtttgccgccttttccaacacttcgcgcgtgcgtgcgtctgatttgccttcttggatgtagagttcgacgatggatttggggttttgccacaatcgggcgttgacggcgtggaagccgtagatgggtctttggtttgccatgatggtgctttgtaaaaagggttcagacagcattatagcaatttgccggtatgccgtctgaaagggttaaaacaggtaggcgatgtatttcaccaacaggataaacaagatggatacggcgcagccgattttgaacgccgtgccgacgacaagccccaacagcgtacccaagcccgctttacctgcctgaagcatattgcgccgttcgatcagttcgcctgccgccgcgccgataaagggaccgagtattagtccgggaagggagaaaaatatgccgatgatgctgccggccaatgcgccgcgaacggcgagcttgcccgctccggtatattttgtcccccatatgcctgccacatagtccgccagtatgccggcaaggctgatgagtccgaccgtccacaaaacgcccgcgccgtagatttggtagccgccggcataggcaagcagccatgttccggcaaacatcaatgccaatccgggcagggcggggtaaacgatgcccgccgtgccgacggctatcagggcgagggcgaggatgacggtcagtacggtcataggttcaaccttttcttttgttttgaaaaaaacggcttaacacggcgcggcattcttcttgcaggattccgccccgtatggcggtgtgcgtattgaggcgtttgtcggcaaacaggttgacgatgctgcctgccgcgccggttttgggttctgccgccccgtagatcacacgcctgattcgtgcctgtatcagtgcggacgcgcacatggcgcagggttcgagggtgatatatatgtcgcatccgtcaaggcggtagttttgtatttctctgcctgcctgtgccaaggcgttgatttcggcgtgtcggctgacattgcagtcggcaatgcaggtgttgtgtgccgatgcgatgattttgccgtctgaaacgatgactgccccgacgggtatttcgccgtcggcggaggattgttctgcttggcgcagtgcttcgcacatgaagtgttccatttcttcctgcggcggaaaggcggcgacgggcggatggttttttaactcggcaagcaggcgggctttatgcgcttgggacatttcttgcggcggcgtgccgtccagcagcgactcgagttgccacagtgtgcttttcgtgagggtcaaacccgatgctttgagcagcagaaaggctttgaccgaaccgttttgccgcagttcttcgagtgtacggataccgagcctgtgcagggcggcgacggttttgggggcgagcggcggtgtggtcagcatggtttatgcgccgaaaaaccgttttgccgcctcaatcaggcgtgtgcatgaagtgcagtctgaaaacgggtcggcaacgcagtctaaaggtgttttgcgcaaccaagtcagttggcgtttggcaagttggcgggtggcggcaatgcctttctcgacaaatgccgggaaatcggtttttccatccagatatttccatgcctgacggtagccgacgcagcggatggcgggggagtaggcggtcaggccgggatagcggcggcgcaggttttctacttcgccgataaagccctgttcaagcatcaggtggaaacgcagggcgatgttttcatgcaggcgggcacggttttcgggaatcagggcggcggtatgcaaatcaaaagggagcgtatgggaggtcaggctgccgagatgtgtgctcatcggtttgccggttaaataataaacttccaaagcgcgtccgatacgctggctgtcgttcggtttcagacggcatgcggtttcagggtcgactttttgcagggtgcggtagaggaaatccaagccgtacatctgtttttgttcgtccaagtcggcacgcaggcaggcgtcggcttcgggcaaatcgttcaaaccttgggtcagggcgcggaaatacatcatcgtgccgccgacaataagggcaaacctgccgcgtgaggaaatttccccgaccaagcgcgtgcagtcttcgacaaagcgggcggcgctgtatgattcggtaggcgggatgatgtcgataaggtggtgcgggacaaaggcgcgttcggaggcggacggtttcgccgtgccgatgtccatatcgcggtaaaccagcgcggaatcgaggctgatgatttcgacaggcagggtttcggcaattttgagggcgagcgcggttttgcctccggcggtcggcccgagcagggcaaaggctttcggggtcggcataacgtttcaggtttggaaaaatacggattatagcggaaagcgtgccgacgttatattttggtttgcggaagcacgccgacggcaagggggcgtgtttaccgtatgcctttatatagtggattaacaaaaaccagtacggtgttgcctcgccttagctcaaagagaacgattctctaaggtgctgaagcaccgagtgaatcggttccgtactatctgtactgtctgcggcttcgtcgccttgtcctgatttttgttaatccactataaaatttcaaaccgacgcgccgggttttcaatatgcccgcgcccgatgccgccttgtccgcaggcatcagcggcagtgtccgattttttggggaatgcccgtcccgggcgtatttaaaggttcggcggtgcggcgttttcctgcggcaaggcttcagacggcatctctggtgcgtccgttagacaaggcgtgcgcttggggcgataatggcgttttgcttttttgaaagccttgcaatgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttagcccgtttccgttatttctatgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctagaatagcgcgttttacgacaaccgatttgattggaaaatcacaatgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgcggcttccgaaaccatttacaaagccgacgacaaattcgacgtggtcatcctgtcccgcaaaaactgtacgtacagctactttgccgacccgatgtacgtctttatggacgaagaattcaaccaatacgaaatcgaagctgacaacatcggcgacgcgttgaaattcatcgttgacggtatggaagaccaatgcgaagtaaccttctacgaaggcaaccctatctccgtagaactgcccaccatcatcgtgcgcgaagtcgagtacaccgagcctgccgtcaaaggcgatacttccggcaaagtgatgaaaaccgcccgcctggtcggtggcaccgaaatccaagtgatgtcttacatcgaaaacggcgataaagtcgaaatcgacacccgcaccggcgaattccgcaaacgcgcctgatttgccgcattgaaaaatgccgtctgaaaacgtttcagacggcattttttttatattcgccccgtgtttggattgaagtagatgtttttttcgtaaacgacaatacgcgtgattttgccattttcgtcaaaatggatgtctaaaaacggtttgtcgggattgcgttcacggttggacagccggaagagtgattggttttcaagcatttctccgtgtattttcagatagccgggcaattggctgatgtattggaaattgccgccaagtccgttgttgtgccggctcgaataggcaggggttgccgaaacttcaaaataacgcgtgcgtttcggctcctcgccttgtccgcgggtttcttgactgccctgtatcagcaacagcgtcgcttctcggaggcggcgttcctgttccatcaaggcattttgtgcctgccggctgatcgtgcgctttccgtaacgcaagtcttcaattgccagtatgattttctgatggtagtcgggatcttcagggcggatgtcgggaaacagcagccgctgtatgttgtcatagccaccgtcgggtaagccgaaacgggtttccagttcgtgatgggaaagggcaaacagacagtccgagtcaatgtgttcggcgatttgctgcatgagatcgtcaatgccggtggcggggtgcaggctggtgcaatttgacggcggcgcgctttctgcctgcttgacgttatcaggggcggatgcggtcggttgcaaatcggtttgggaaggagctgatgacgcggaggacgaagcagcggatgcaccgacttctttggttttatcgtctttgctcggagaacacgcggtcagcatgattgcggtaagccataagagaagtgatgaggttttgtttttcattctattgtttccagtattaaagaggccgtctgaaaacctaccgtttcatttttcagacggcctgttgttaatagaaccgaagaacctgttaatgccgacaaggttctcaacctgtcttacccgacgcggtaaaacgccaggctgcccaaaaggttggggaaatgtttgacctgtctgttgcccgtcatcacggcgcgctcgaggatgcggatgttgtttttggcgcacaataaatcaaagtctttgagcgtgcaccaatggatattgggcgtgtcgtaccaatggtagggcatacgttcggaaaccggcatatgtccgccgagtgcgatttggacgcggttgcgccagtagccgaaattcgggaagctgacaatcgcctgtttggcaacgcgcatcaggcagcgcaggattttttcggtattctgcatcgcttggatggtttggctcaacacaatcacatcaaaactttgatcgttgaatgcggttaaaccttcttccaaatcggcttggataacatttacgccgcgcgacatcgcggcgatgacgctatttgtgtcgatttcgatgccgtagccgctgcattttttgtgttcgaccaatgcggcaagcagttcgccgtcgccgcagcccaagtccaagacgcggctgccttcgggtatccggtcgtaaatcagttgcaaatcatcgcgcaggttcattgctgacattccttataaacgttgttcatataggcggcgaccgcacgcatataggcttcgtcttccattaaaaaggcatcgtgcccgtgtgcggatttgacttcgatatactgcacggatttttgggcggcaatcagtgccttgaccagttcgtgcgaacgttcgggtgcgaaacgccagtcggtgctgaagctggcgacaaagaatttcgctttcacattttgcagggcgcgggtcaggctgtcgccgaaatctgccgccggatcgaaatagtccaaagccttggtcatgagcaggtaagtgttggcgtcgaaccgtccgacgaatttgtcgccctgatagcgaagataggattccacttcaaattcaacaccaaagccgtattgataaccgttggaacgcaaatcgcgtccgaattttttgcctaaaccgtcttcggcaagataagtgatgtgtcccatcatgcgggcaatccgcaagccccgtgcaggaacggtattgtggctgcggtaatgtccttcattgaaatcagggtcggtcaaaattgcctgacgcgccacatcgttaaacgcgatattttgcgtggacagtttcggcgcagacgcaatcactaaagcatggcgcacgcgctcgggataggaaatcgtccactgcaaggcctgcataccgcccaagctgccaccgacaatcgccgcccattgttcgataccgagatagtcggcaagcgcggcttgggattttacccagtccttcaccgtaaccaccggaaaatccgcgccgtattccctgcccgtttcaggattaatcgacaaaggcccgctgctgccgtcgcagccgcccagattattcaaaccgaccacgaaaaaacgttccgtatcaatcggtttgccaggtccgaccatattgtcccaccagcccgtatatttatcttccgccgaatgcctgcccgcaacatgatggttgcccgacagcgcgtggcagattaaaaccgcattgtttttttcagcattcagctcgccgtaggtttcaatcatcagatcgaaacgcggcaaagttttaccgttttccaaaaccagcggcatctcaaacggaattttttggggcattacaatgcccaccgaggcattttgactcatatcctgttccaacaaatgcggcgaaaagcgttattatatcgcaaacggcatgactttttgacacggtcggacaagcagccggacgcgtttgaccctcatccgccgcacacgaatcatactttttcagacgacctccaccgcttcccgacatgataggcagacttttccgtatttttttctttttcgcacttgccgcgttgattatcaaccgccttttcagccgcaggcaaaaacgcgccctgcgcgaagtcgccgaaatcagcgcatgggtactgctcggtgcagccgccgcgatgctgttttggtatctgtttatgctgtatttcaaacacattccggattcgtattgacggaaaaaatgccgtctgaaacgcatttttctgtttcagacggcatatttgatgaaaagggcttgcggtaggaggtgctttatagtggattaactttaaaccagtacggcgttgcctcgccttgccgtactatttgtactgtctgcggcttcgtcgccttgtcctgatttttgttaatccactatacaaccgaagcaggaagggcagggggtcagcgttggcgcgctttaaaacgcggattgcttttgcagatgacgtaaactttgcccctgcgcctgacgatttggcagtcgcggtggcgttgtttggcggttttgagtgaagacagaacctgcattatttgtcctttctaaacgatgacattacggattggaaacgttggttgaatttgctggcacggccttcggtgttgacgttgcgctgtttgccagtatagacgggatgggatgcggaagaagtatccagcgaaaacagcggatattctttgccgtctgtccaaaccatcgtttttccgtgtgtttcggcacaggagcggattaaccagccttcattggcgctgctatcgaaaaaaaggacggttcggtaattgtcgggatgaatattcggtttcatatattgccttgctttcagtgttataacataacaaactctagcatagtttagaagggctgtacaaggaaatttaactatttttgtaatatattagaaattttcatgataaatctgaaaattttgaaattgactcatgtttggcgcaactttattatgttgcctgaaacatcatataaaagataataaaaggtacgcagccatgaattacgcaaaagaaatcaatgcgttaaataacagcctttccgatttgaaaggcgacatcaacgtttcattcgaatttttcccgccgaaaaacgaacaaatggaaaccatgctgtgggattccatccatcgcctgcaaaccttgcacccgaaatttgtttccgtaacttacggtgcaaactcaggcgagcgcgaccgcacacacggcatcgtcaaacgcatcaaacaggaaaccggcttggaagccgcgcctcacctgaccggtatcgacgcttctcccgacgaattgcgccaaattgccaaagattattgggacagcggcatccgccgcattgtcgccctgcgcggagacgagccggccggttatgagaaaaaaccgttttacgccgaagacttggttaagctattacgctccgtcgccgacttcgacatctctgtagcagcatatcccgaagtgcatcccgaagcgaaatccgcacaagccgacctgattaatttgaaacgcaaaatcgatgcgggcgcgaaccacgtcatcacccaattcttcttcgatgtggaacgctacctgcgcttccgcgaccgctgcgtgatgttgggtatcgatgtggaaatcgtccccggtattttgcctgttaccaacttcaagcagctcggtaaaatggctcaagtaaccaacgtcaaaatcccaagctggctgtcgcaaatgtatgaaggtttggacgacgaccaaggtacgcgcaatctggtggcggcaagtatcgccatcgatatggtcaaagtcctgtcccgcgaaggcgtgaaagatttccacttctatacgcttaaccgcagcgagctgacttacgccatttgccatattttaggcgtgcgcccttaaagccgtatcaaacagtttcagacggcatctaaggtgtctaaaaagcaaaacaccgccccatccgagccattctgatttacaataccggccgattcggattgaaccggtccttacaaaatccaactggagagttcaacatgacaacattacatttctcaggcttcccgcgtgtcggcgccttccgcgaattgaaattcgcacaagaaaaatactggcgcaaagaaatcagcgagcaagaattgctggctgttgctaaagacttgcgcgagaaaaactggaaacaccaggtcgctgccaacgccgatttcgttgccgtaggcgatttcactttctacgaccacatcctcgacctgcaagtcgccaccggcgcgattcccgcccgcttcggcttcgacagccaaaacctgtctttggaacaattcttccaactggcgcgcggtaacaaagaccaattcgctatcgaaatgaccaaatggttcgacaccaactaccactacttggtgcctgaattccacgccgataccgaattcaaagccaatgccaaacactatgttcaacaactgcaagaagcccaagccctcggtctgaaagccaaaccgaccgttgtaggtccgttgactttcctgtgggtgggtaaagaaaaaggcgccgtcgaattcgaccgtctgagcctgttgcctaaactgttgcctgtttacgttgaaatcctgactgctttggttgaagccggtgccgagtggattcaaatcgacgagcctgctttggctgtcgatttgcctaaagaatgggtggaagcctacaaagacgtttacgctactttgagcaaagtaagtgccaaaatcctgttgagcacttacttcggttctgttgccgaacacgccgcattgttgaaagccctgcctgttgacggtctgcacatcgacttggtacgcgcccccgagcaactggacgcgttcgccgactacgacaaagtcctgtctgccggcgtgattgacggccgcaacatttggcgcgccaacctgaacaaagttttggaaactgtcgagcctctgcaagccaaactgggtgaccgtttgtggatttccagctcttgctcgctgctgcacactccatttgacttgtcagttgaagaaaaactgaaagccaacaaacccgacctgtactcttggttggcattcaccctgcaaaaaacccaagaattgcgcgttctgaaagctgcattgaacgaaggccgtgattctgttgccgaagaactcgccgccagccaagctgctgccgactcccgtgccaacagcagcgaaatccatcgtgcagacgttgccaaacgcctggccgatttgcctgccaacgcagaccaacgcaaatctccatttgccgaccgtatcaaagcgcaacaagcatggttgaacctacctctgctaccgactaccaacatcggttctttcccgcaaaccaccgaaatccgccaggcacgctcagccttcaaaaaaggcgaactgtctgccgccgattacgaagccgcgatgaaaaaagaaatcgccttggtggttgaagagcaagaaaaactggacttggacgtactggtacacggcgaagccgagcgtaacgacatggttgaatacttcggcgaattgttgagcggttttgcattcactcaatacggctgggtacaaagctacggctcacgctgcgtgaaaccaccgattatctttggcgacgtaagccgtcctgaagccatgaccgtggcttggtctacttacgcacaaagcctgaccaaacgcccgatgaaaggtatgttgaccggccctgtaaccattctgcaatggtctttcgtccgcaacgacattcctcgctctaccgtgtgcaaacaaatcgcactggctctgaacgacgaagtattggatctggaaaaagccggcatcaaagtcatccaaattgacgaacctgccatccgcgaaggcttgccgctgaaacgcgccgattgggatgcctacctgaactgggcgggcgaatccttccgcctgtcctctgccggttgcgaagacagcacccaaatccacactcatatgtgttactccgagttcaacgatatcctgcctgcgattgctgcaatggatgcggacgtgatcaccatcgagacttcacgttccgacatggaactcttgaccgcgttcggcgaattccaatacccgaacgacatcggcccgggggtttacgacatccacagcccgcgcgtaccgacagaagccgaagtggagcacctgttgcgcaaagccatcgaggttgtaccggttgaacgtctgtgggttaacccggactgcggcctgaaaacacgcggctggaaagaaactctggaacaactccaagtaatgatgaacgtaacccgaaaactgcgtgccgaattggcgaaataagccgagaccgtatgaataaataccgtctgaaagcctttcagacggtattttgtcctgatttgcggcgcaagggcgcagttgccggaaaatcttttcattgcagcttgtttttttctaattcggctttatatgtgggaaacaggcaaatcggagttgtgtttgatagttttaaataatttatattatttgaactataaattatacaaatcattttgcatggggtagaatgcccagcgattcacaattatttctcaaaccaatctattaaggagcttaaaatggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctactgcgtatctgtaaacgatacgttcgtaatgaacgcttgggctgccgaagaagaatccgacaacatctacatgattcctgacggcaacggcgaatttaccgaaggtatgggtatgctggtcggtaaagaagacttgggcttcggtaaacgctcttggcgttactccatgctggttaacgacggcgtggttgaaaaaatgttcatcgaacctgaagaaccgggcgatccgttcaaagtatccgatgcagatactatgctgcaattcgttgctcccgattggaaggctcaagagtctgtggcaattttcactaaaccaggttgccaattctgcgctaaagccaaacaagctttgcaagacaaaggtttgtcttacgaagaaatcgtattgggcaaagatgcaaccgtcacttccgttcgcgccattaccggcaagatgactgcccctcaagtcttcatcggcggtaaatacatcggcggcagcgaagatttggaagcttacttggctaaaaactgatagctgtttgcttaaggcggtttaattaaactgtctgatataccggatagagttattcgggcggttctacactaccgctccgaataactctatatttataagagaatttggatattgttgcactcaatcgaaattttgtttttatttatctgaatgatgtttttgattgggaaaatatttaaatgccgtctgaaaccgatatgttctgtgtcggcaatgtttcagacgaaaacggaaggacaaagattatgaaaaaaattcaagcggatgtcgtcgtaatcggcggcggtactgccggtatgggtgcgtttcgcaatgcccgtttacattcggataatgtttacctgattgaaaacaatgtgttcggcacgacctgcgcgcgcgtgggctgtatgccttccaaactcttgattgccgccgcagaggcgcgtcatcacgcattgcataccgacccgttcggcgtgcatttggacaaagacagcatcgtcgtcaacggtgaagaggtcatgcagcgcgttaaatccgagcgtgaccgttttgtcggctttgtcgttgccgatgtggaagagtggcctgccgacaagcgcattatgggttcggctaaatttatcgacgagcataccgtccaaatcgacgagcatactcaaattacggcaaaaagtttcgtgattgctaccggttcgcgtcccgtcatcctgccgcaatggcagtctttgggcaatcgtttgattatcaacgatgacgttttctcatgggatacgctgcctaagcgcgttgccgtgttcgggccgggtgttatcggtttggaactgggtcaggcattgcaccgtttgggcgtgaaagttgaaattttcggtttgggcggaatcatcggcggcatttccgaccccgtcgtttcagacgaggcgaacgccgtgttcggcgaagaattgaaactgcatctggatgctaaaaccgaggtcaaactcgatgcagacggcaatgtagaagtccattgggagcaggatggcgaaaaaggcgtatttgttgccgaatatatgctggcagccgtgggccgccgtccgaacgttgacaatatcggtttggaaaatatcaatatcgaaaaagatgcgcgcggcgtacctgttgccgacccgctgaccatgcagaccagtattccgcatatcttcatcgcaggcgatgcgtccaaccaactgcctctgctgcatgaagctgccgaccaaggcaagattgccggcgataacgcgggccgctacccgaatatcggcggcggtttgcggcgcagcaccatcggcgtggtgtttaccagtccgcaaatcggctttgtcggtctgaaatacgcgcaggttgccgcgcaataccaagccgacgaatttgtcatcggcgaagtatcgttcaaaaaccaaggccgcagccgcgtgatgctggtgaacaaaggccatatgcgcctgtatgccgaaaaagccaccggccgctttatcggcgcggaaatcgtaggccctgccgccgaacatttggcgcacctgttggcttgggcacatcaaatgaagatgaccgttccgcaaatgctggatatgccgttctaccatcccgttatcgaggaaggtctgcgtaccgcgttgcgcgatgccgatgcgaaattgaaagcctgaccgatatggcaaaacaatgccgtctgaaattttttcagacggcattttgtttttggggatggggtcggatgctgataccgtgtcgggaagggggcggcaaaactaaaaatctttcttttaatctgctgtttccacgcgtgtttgtcaaaatctatcagtttgtttttaaaatacactgttcaaaatgggataaaacaggtaaattaacgtttatgtaacccagtgtagcaatgggtttacggtttttgagtcgatatataactacagaggaattgactatgtctgccaaaccgcgtcctgtttatctggatttgccgaacatccgtctgccgatacccgggatagtttccatccttcaccgcatcagcggggtcgggctgtttattatgctgcctttcctgctgtatttcctgtccggtaccctgagtcaagagtctgcatttgaaacttaccgtgccattgtttcccatcctttggtcaagctggttttaatcggtgtattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaagtatgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatgcgttttcagacagtcttcgcctcaaaggtcgtctgaaatctaaccatacccacattgaactgcttgaatttataatacaaaatcattgggcagttgatgagaaaaggaacacttctcatggaaaaaatgagttttgaaatttaccgttacaacccggatgttgatgccaagccttatatgcagcgttacgagttggaattggaaccgaccgacgtgaaacttttggatgctttggtacgcctgaaagcacaagacgataccttgtctttccgccgctcctgccgcgaaggcatttgcggatcggacggtatgaacatcaacggcaaaaacggcttggcgtgtttgaccgatctgcgtggcttgaaacagccagttaaaatccgtcctctgccaggtctgcctgttatccgcgacctgattgtggatatgacccagttcttcaaacaataccattccgtcaaaccttatgttgtcaacgataatccgattgatgcggacaaagagcgtctgcaaactcaggaagagcgtaaagagttggacggtttgtacgagtgtattttgtgcgcctgctgttcgactgcctgcccgtcattttggtggaaccctgataaattcgtcggtccgtccggtttgctgaatgcttaccgtttcattgcggacagccgtgataccatcactaatgagcgtttggataatctgaacgacccataccgtttgttccgttgccacaccattatgaactgcgtagacgtatgtcctaaacacttgaatccgacccgagccatcggtaagattaaagagattatgttgaaacgggccgtttaagaaatgatggtttttgacgatattgccaaacggaaaatccgttttcaaacccgccggggattgttggaattagatttaatcttcggcaggtttatggaaaaagaattcgagcatttgagcgataaagagctgtccgagttttccgaaatccttgaatttcaagatcaagaattgcttgccttgattaacgggcattcggaaacggacaaagggcaccttatcccgatgcttgaaaaaatcagacgggcatgaggcatctgaaatctgcctgcaggcagatttcaaaatgcaaaagccgtctgaaggcaaagaacgtgctgcggatgcagtaacgtgggttataacttgcaaaggagcaataatatgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaacatacattaatatattgtcaaacaggcaatatcagagaaccggattgtttcccgaatccgtctgattgtagtcggatgaaatcaagacaagcaatccggtttaaaatagggtagaataaaatgtcttttcaggcggcatcagtttagccgtcaggacgcggacttctaccctttgtttatattttaaagaaaagagcgcacgccatgatggacgaaaaactcaatttctcttacctgttcggttcaaacgcaccttacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttccgcctatcgtatccaaggcgtgggtgcagcccaacttgatccgctcaaacgtatccccccgcgcgatattgaagccctcgatccgaaattccacggtctgtcagatgccgatatggcgcttcaattcaatatgggcgagggcgattttgccaatcgcggcaaactgcctttgtcccaaatcatcagcaacctcaaacaaacctactgcggccacatcgcattggaatatatctatattcccaataccgaagagcgccgctgggtacgcaattattttgaaagcgtattgtccacaccgcattacaatgccgatcaaaaacgccgtatcttgaaagagatgactgctgccgagactttggaacgttatctgcataccaaatatgtcggtcagaaacgtttcggtgtcgaaggcggcgaaagcgcgattgccggtttgaactacctgattcaaaacgccggtaaagacggtgtggaagaggtcatcatcggtatggcgcaccgtggccgtctgaatgttttggtgaacattttgggcaaaaaacccggcgatttgtttgccgaatttgaaggtcgtgccgaaatcaaactgcccagcggcgacgtgaaataccatatgggcttcagctccgatattgccacgccgcacggcccgatgcacgtttctttggcgttcaacccgtcacacttggaaatcgtcaacccggtggtggaaggttctgcgcgcgccaaacaaaaacgtttgggcgaaaacggccgcgacaaagtcttgccggtattgattcacggcgactccgcatttatcggtctgggagtcaaccaagcgacattcaacctgtctaaaacgcgcggttataccaccggcggtacggttcatatcgtcatcaacaaccaaatcggctttaccacttccgatatccgcgatacccgttcaaccgtacactgtaccgatatcgcaaaaatggtttccgccccggttatccatgtgaacggcgatgatcccgaacgcgtttgctttgctatccaagccgctttggattaccgcaaaaaattccataaagacatcgtgattgacgttgtctgctaccgtaaatggggtcacaacgagggcgatgatccgaccttgacccaaccgatgatgtacaaaaaagtatcgcaacaccccggtgcgcgtgctttgtacaccgagcaactgattgccgaaggcgtggtaacccaagccgaggctgacggttacatccaagcttaccgtgatgctttggacaaaggcgagcacgtcgagcaaacaacgttgagcaacttccaacgcacgcaaatcgactggagcaaataccaaggcaaagattggcgcgaacacatcgaaaccggtttgcctgccgcagatattgaacgtctcactgagaagtttaccgccgtaccggaaggctttgccctgcatccgactgcaaaacgtgtgattgaagcgcgtaaagccatggcatccggcaaacaggccatagattggggtatggccgaaaccttggcatacgccagcctcgtaaccaaaggtcacggcgtgcgtatttccggcgaggactcgggacgcggcacgttctcgcaccgccacgccgtattgcacgatcaaaaacgcgaaaaatgggacgacggtacttatgttcctctgcgccatatgggcgaaggcatgggcgagttcctggttatcgactccattttgaacgaagaagccgtgatggcgttcgagtacggctttgcctgctccgcacctgacaaactgaccatttgggaagctcaattcggtgacttcgccaacggcgcgcaagtgactattgaccaattcctgtcttcaggcgaaaccaagtggggtcgtttgtgcggtctgactaccatcctgccgcacggctacgacggtcaaggccccgagcactcttctgcacgcgtagaacgttggttgcaactgtgttctgagaacaatatgcaagtcattatgccgtctgaagcgtcgcaaatgttccacctcttgcaacgtcaagtcttgggttcataccgcaaaccgctggtgattttcatgtccaaacgcctgttgcgcttcaaaggtgcaatgagcccgctggaaaacttcaccgaaggttcgaccttccgtccggttatcggcgataccgcagaacgcgcaagcaacgacagcgtgaaacgcgtggtattgtgtgccggtcaggtttactatgacttggaagccggccgtgccgagcgtaaactggaagatgatgttgctattgtccgcgttgagcagctgtatccgttcccatatgacgaggttaaagctgaactggcgaaatatccgaacgcaaaatctgtggtttgggcacaagaagagccgaaaaaccaaggcgcgttctaccaaatccgccaccgcatcgaagatgttattagcgaagagcaaaaactgtcttatgccggtcgtccaagcagcgcatcgcctgcagtgggctactcaagcaaacacattgctcaattgaaacaattggttgaagacgctttggcattgtaaaccaagtagcattccgtctgagtctgctcagatggaatgcccatatgcagaattaaaaacacacaacaggccgtctgaaagggccattggagacacaaaatgattattgatgtaaaagtacctatgttgtctgaaagcgtatctgaaggcacgctcttggaatggaagaaaaaagttggcgaagccgttgcccgtgacgaaatcctgatcgatatcgaaacggacaaagtggttttggaagtaccttctccacaagccggcgtattggttgaaatcgtagctcaagacggtgaaaccgttgttgccgaccaagttttggcgcgcgtcgatacagctgctactgccgctgctgaagccccagccgccgctcctgcagaagctgccccagctgccgctcctgctgctacacaaaacaacgccgctatgcctgctgccgccaaactggctgccgagaccggtgttgacgtgaacgcattgcaaggttccggccgtgacggtcgcgtattgaaagaagacgtacaaaatgccgctgccaaacctgccggagccgctgctcctgctgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccaatcatggacttgcgtgcgaagtacaaagaaaaattcgagaaagaacacggcgtgaaactgggctttatgtccttcttcgttaaagccgctgttgccgccctgaaaaaatacccggttgtgaatgcttctgttgacggcaaagacatcgtgtaccacggctacttcgacatcggtatcgcaattggcagcccacgcggtttggttgtgccaattctgcgtgatgccgaccaaatgagcattgccgacatcgaacaagcaattgttgattacgcgaaaaaagccaaagacggcaaaatcgctatcgaagatctgaccggcggtacattcagtattaccaacggcggtactttcggttctatgatgtctaccccgatcatcaacccacctcaatctgcgattttgggtatgcacgccactaaagagcgcgctgtggttgaaaacggccaagttgttgtccgtccgatgatgtatctggctctgtcttacgaccaccgtatcattgacggccgcgaagctgtattgaccttggtagccattaaagacgcgttggaagacccggcccgcctgttgttggatctgtaatcgtttcagacggccttttatttgttaatgaaaaggccgtctgaatttttatagtggattaaatttaaaccagtacggcgttgcctcgccttgccgtactatctgtactgtctgcggcttcgtcgccttgtcctgatttaaatttaatccactatatttagatgtagcgtaatgtagtatcgtgctacaataggctcaacgaacgattgaggccgtctgaaacatttgattcgaatgaatcggcagatatggactttcagacggccttttcttaaaaccatcaaaacgcagtcattcaaaataaaaaagaaacaaaaagtatcgtttttattttgagatactgttaaaagcaaaggatgacacgatgtctcaatatgatgtagtagtgattggtgcaggcccgggtggatacgttgccgccatccgtgccgcgcaactgggtttcaaaaccgcttgcgtcgatgcaggcgttaacaaagcaggcaatgcccctgcattgggcggtacttgcttgaacgtaggctgtatcccttctaaagccctgttgcaatccagcgaacatttccacgctgcgcaacacgagtttgccgaacacggtatcactgtcggcgacgtaaaattcgacgcggccaaaatgattgagcgcaaagatgccatcgtgaccaagctgaccggcggcgtcaaattcctgttccaaaaaaataaagtaaccagcctgttcggtacggcttcctttgccggtaaaaatggcgatgcttaccaaatcgaagtcgataacaaaggcgagaaaaccgttatcgaagccaaacacgtcatcgtagccaccggttccgtaccgcgtccgctgccacaagtcgctatcgacaatgtgaacgtattggacaacgaaggtgcattgaacctgaccgaagtacctgccaaactcggcgtgatcggttccggcgtgattggtttggaaatgggttccgtatggaaccgcgtgggtgcggaagttaccattcttgaagccgcgccgactttcctggctgccgccgaccaacaaatcgccaaagaagccttcaaatacttcaccaaagagcaaggtctgagcatcgaattgggcgtgaaaatcggcgacatcaagtctgaaggcaaaggtgtttccgttgcttacgaaactgctgctggcgaagccaaaaccgaagtattcgacaaactgatcgttgccatcggccgtattccaaacaccaaaggcctgaacgcggaagccgtaggcttggaaaaagacgagcgcggctttatcaaagtagatggcgaatgccgtaccaacctgcctaacgtatgggcaatcggcgacgtggttcgcggcccgatgttggcacacaaagccagcgacgaaggcgttgccgttgccgaacgcattgccggtcaaaaaccgcatatcgacttcaacaacgtaccgttcgtgatttacaccgatcctgaaatcgcttgggtgggtaaaaccgaagagcagctcaaagccgaaggcgtggagtacaaaaaaggtacttcaggttttggtgcgaatggtcgcgcattggcaatgggcaaagccaaaggtacggttaaagtgttggcagatgccaaaaccgaccgcatcttgggcgtacacatgattggtccggttgtcagcgaattggttaccgaaggcgtgactgcgctcgaattcttcgccagcagcgaagacatcgcccgcattatccatgcccacccaaccttgtccgaagtggttcacgaagctgcattggcggccgacaaacgcgctttgcacggttgatagacattaaggccgtctgaaatttttcagacggccttaaggccttcgacaaattgaatgttccgagagctccgttttctgatttataattccgtcagacaaacaaacagcatttacattcattatgaacaaagaaatagtcggtattttctttataccggcgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagccatgtatctgctggcgcggatgtggttgcctttcagcaagtgaaacgacgattttccgaccgccgaaaggtagtctgaaacgcacgggcttgccatttggaggcagactcggggcattccactaatctaaaggagaaatccatgaatttacacgagtatcaggctaaagaactgctggctagctacggtttgcccgtacaaggcggtattttggcacacaacggcgaagaagccgctgcagcttacgacaaattgggcggcaaattcgctgttgtcaaagcacaagtacacgccggcggccgcggtaaagcgggcggcgtaaaagtcgttaaaagccgcgaagaagctaaagaagtggctgaaagcctgattggcaccaacttggtaacttaccaaaccgatgccaacggccaacctgtcaacagtgttttggtttgcgaagacatgtatccggttcaaaccgagctgtacttgggcgcagtggttgaccgttctacccgccgcattacattcatggcctctaccgaaggcggcgtggaaatcgaaaaagttgctgccgaaactcctgaaaaaatcttcaaagtaaccgttgatccgctggtcggcctgcaaccttgccaagctcgcgaagttgcgttccaactgggcttgaaagacaaacaaatcaacgagttcgtcaaactgatgaccggtgcgtacaaagcgtttgtcgaaaatgacttcgccctgtttgaagtcaacccgctggcagttcgcgaaaacggcgcgctcgcctgcgtggacggcaaaatcggcatcgacagcaacgcgctctaccgcctgccgaaaatcgccgaattgcgcgacaaatctcaagaaaacgaacgcgagttgaaagcttctgaatttgacctgaactatgttgccctggaaggcaacatcggctgtatggtgaacggtgccggtttggcgatggccactatggacatcatcaaactgaaaggcggccaacctgccaacttcttggacgttggcggcggcgcaaccaaagaccgcgtggttgaagcgttcaaactgattctggaagacaaatccgttcaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggcctgaatgacgcagccgaaaaaattgttgcagccgtaaacgcctaaggagaaaagaatgagcgtattgattaataaagacactaaagtattggttcaaggtttcaccggtaaaaacggtactttccactccgaacaagctctggcttacggcactaaagttgtcggcggcgttaccccgggcaaaggcggtcaaacccacctgaacctgcccgtgttcaacaccatgaaagaagccgttaaagaaaccggcgcggatgcatccgtgatttacgttcctgctccgtttgtgttggattctatcgttgaagcagttgattcaggcgtaggcttggtcgttgtgattaccgaaggcgtgccgactttggacatgctcaaagccaaacgctacttggaaaccaacggtaacggaacacgtttggtcggccctaactgcccgggcgtgattactccgggcgagtgcaaaatcggcattatgccgggccacatccatactcccggccgcatcggcatcatttcccgttccggtacattgacttacgaagccgtggcacaaaccaccaaactgggcttgggtcaatcaacctgtatcggtatcggcggcgacccgattccgggtatgaaccaaatcgacgcactgaaacttttccaagaagacccggataccgacgccatcatcatgatcggtgaaattggcggtactgcggaagaagaagcagccgaatacatccaatccaacgtaagcaaacctgttgtcggctatatcgccggtgttaccgcacctaaaggcaaacgcatgggtcacgccggtgcgattatctccggcggcaaaggtactgcggaagaaaaattcgccgctttcgaaaaagccggtatcgcttacacccgcagccctgccgagttgggcactaccatgctggaagtgttgaaagcaaaaggtttggcataatcaggtttgacaactgattgaacatcaaatgccgtctgaaaccggaaatcgggtttcagacggcattttgtttgtcatttcaaaaagaggcagcctcaacatacccacattatttttgcccttttggggcagtcagagacctttgcaaaattccccaaaatcccctaaattccctaaattcccaccaagacatttaggggattttggggaattttgcaaaggtctcgggctaagtgtgcctgtttgcgcctaaaaggcggcccggatgcctgattatcgggtatcctgggaggattaagggggtattggggtaaaattagtggatatttgaaacgaaaacagccgaaaacctgtgtttgggtttcggctgtcgggagggaaaggaattttgcaaagctctcgtattggctttgaagttccgtgtaattcacaggtagggcgtgtggcacagccacgcacgcggtcggttgggtatgcaggctacggctttctctgttgaaactgcaacacgtcagctaccaaccgtgtgcgtagcgcacacggttggttgggatacaagttactgtttgttcttaaatggagtaccaacatcaagggcttttgataatcctgaaaatattaaatattcagtttcagtttttattttaggagaaatatttgcataatttctatctttaaagcaccaatggatatatggtttcgtttcatcttctgggttatctaaataagcaataacattcaagtcaaataaaaattgcaaaaactcattagcagtactcataaatttaggtatttccactgatgttgtttgtaagtgctttttcaaacgttcaaatgcttttaaaaaatcactatatttaaatctatctttcccgtttaaaaattcaaaaaatttcaggaaattttgataatcactttgactataataaaacaaaagatgatctttgatttcaccaagtaaatatatcgagtattctctttgaaaagaagtattatcaaaatcttctgctacgacataatcttccttacttttcttatttttttgtagcaaagtaagcatctgaagaatatcgcgaggtcgataatacgattttcttaggaagctaataaatgaagttaaatttttatactcatcatgtaaattaggagcattccatggaaaataataatcccatgagttgcctttttctaaactatcttgtttttcttgctgggttctcaaaagatgatcaaaaacgccaaaaatctttgaacttctataagatttataatccgtcctccagtctaaaaatactgaattatcttgaagtttggtattttgattttgtaaacctaatgaatcaaagatatcaggtctaatcaataacacaactctcatccttcccttactatctttaatggaagggaagatatcattatttaacatccatatggcgttagcaagaccttttacacactcatgatattcatcaaatggaatctgtgatggtctaatatctatcccatcaataaacaaaatatgattatcttttagctttaactgagataaagcatctttaaattttctttcaataaaacctaaatttgcttggaatttactttctgtaaaagttatttgttgggattcctcttcacctagtttaacaaattttccaaaaatcatttccgcagcttcttttgaattttctattaaagttattgcttgtacaatttccggatcaaaagcgccataataatattcatttatagcctcatctaaggctttaaatttattaaatattgaagataatattccgttttctttacatttgatttgatttgatatcaacagatataaaatgactttccaaatacttgtaaaatctgaaacagttaagtgtcttgctttctttagctgaataaattttgaataatcggtttcacgaacaaacttagtagtggcatgtatgtttttatagaagttattagttaaataaacagcatatgctgtctttccagttcccttttctccgattaaaaacgaaatatttggttcacataattcatccaaatattctccttttacaaatattcggttaaataaatctttattttctcttcttctgtagtttgcagcatccacaaatccaaattctaatgtttttaacggtttcatcttaataatctcctatttaattttgaattaaacttacctcaaaaccaccttcaaatacttcccagtataactccccttaactttcgccacctgttcaggactacctttagcaataatcctccccccgccatctccgccttccggccccaagtccacaatccaatccgctgttttaatcacatccagattatgctcgataatcactatcgagttgcctttgcctttcagacggcctatgacttccagcagcagggcgatgtcggcgaagtgcaggccggtggtgggttcgtcgaggatgtagagcgttctgccggtgtcgcgtttggagagttccaaggcgagtttcacgcgttgggcttcgccgccggagagggtggtggcggactgtccgaggcggatatagcctaggcctacgtccatcagggtttgcagtttgcgcgatacggtggggacggcgtcgaaaaattcgcgggcttcttcgacggtcatgtcgaggacttggctgatgtttttgcctttgtattggatttcgagcgtttcgcggttgtagcgtttgccgtggcagacttcgcaggggacgtacacgtcgggcaggaagtgcatttcgactttaatcacgccgtcgccttggcaggcttcgcagcggccgcctttgacattgaaggagaatctgccgacgttgtagccgcgttcgcgagagagggggacgccggcgaagagttcgcggataggggtgaacaggccggtgtaggtggcggggttggagcgaggagtacggccgatgggggactgatcgacgttgatgactttgtcgaggtgttcgaggccgtggatgtcgtcgaatggggcgggttcttcttgggcgcggttgagttcgcgggcggtaattttggcgagggtgtcgttaatcagggtggatttgccgctgccggacacgccggtgatgcaggtaatcaaaccgagcggcagctcaagggtaacgtttttgagattgttgccgcgtgcgcctttgaggacgagcatccggtcgggattgacgggcgtgcgttcagacggcacggcaatggattttttgccgctgaggtattgtccggtaacggagttttcgcattgggcgacgttttcgggcgtgtcggcaatcagtacgttgcctccgtgttcgcctgcgccggggcccatatcgaccacgaaatcggcttcgcggatggcgtcttcgtcgtgttcgaccacaatcacgctgttgcccaaatcgcgcaggcgtttgagggtggccagcaggcggtcattgtcacgctggtgcaggccgatggagggttcgtccagtacatacatcacgccggtcaggccgctgccgatttggctggcgaggcggatgcgctgggcttcgccgccggagagggtttcggcggagcggcttaaattcaggtaatccagcccgacgttaatcaggaagccgaggcgttcggtgatttctttgaggattttttcggcgatttgttttttgttgccgtctaaatccagtgtttcaaagaattggtgggttttggtgagcggccaggcggaaacttcgtgcaacggctcaccgctgacgtaaacgtagcgggcttctttgcgcaaacgtgcgccgccgcagcttgggcaggcgcggtggttttggtattcgcgcagtttttcgcgcacggtttcgctgtcggtttcgcggtagcggcgttcgagattggggatgatgccttcaaaggcgtggctgcggttgaaggtggtgccgcgttcggacaggtaagtgaaatcaatgacttctttgcctgagccgtgcagcacaacttttttcactttttcaggtagtgtttcccaagcagcctgcacatcgaaaccgtaatgccgcgccaatgattgaatcatttggaaatagaattggttgcgcttgtcccaaccgtcaatcgcacctgttgccagcgacaattcgggatgggcgaccactttttcggggtcgaagaaattggtgttgcccaagccgtcgcaagtcgggcaggaacccatcgggttgttgaacgaaaaaaggcgaggctctaattcgggcaggctgtacgaacacacggggcaggcgaaacgtgcggaaaaccaatgttcttcgccgctgtccatctccatcgccagcgcacgctcgttgccgtggcgcagcgcggtttcaaaactttccgccagccgctgcttgatgtccgccttcactttcacgcggtcgatgaccacgtcgatattgtgcttgatgtttttttccagcttcggcacttcgtccaactgatagacctcgccgtccacgcgcacccgcgcaaaaccctgcgcctgcaagtcggcaaagaaatcgacaaactcgcccttacgctcgcgcacggtgggggcaagaatcatcacacgcgtgtcttccggcagtttcaatacggcatcgaccatctgcgatacggtttggctcgacagcggcagcttgtgttcgggacaatacggggtaccgacacgggcgtataaaagacgcagatagtcgtggatttcagttaccgtaccgacggtggagcgtgggttgtggctggtggatttttgctcgatggaaattgcaggcgacagaccttcaattaaatcgacatcgggtttgtccatcatctgcaaaaactgccgcgcataggcggaaaggctctcgacataacgccgttgcccttcggcatacagcgtgtcaaacgccagcgacgacttgccgctgcccgacaatcctgttaccaccacgagtttgtggcgcggaatgtctaaatcgatgtttttcaaattatgcgtgcgcgcgccgcggatgcggatggtgtcgttgtcgtgcgaatgttggggatgatggttgcacataatggatgccgcctgaaaaataaaggaaaaccggtattgtagcactttctcggatgccgtctgaagccgcgttcagacggcatttgccagcggagtacggcagattccgctataatgtcggcaattttaacccgcttgaacaaaaggatgacaaatgaaccgtctttacccccacccgattatcgcccgtgagggctggccgattattggcggcggtttggctttgagcctgctggtgtcgatatgttgcggctggtggtctttgccgttttgggtgtttaccgtatttgcattgcagtttttccgcgaccctgcgcgtgagattccgctaaatcctgaagcggtgttgagcccggttgacggccgtatcgtggtggtcgaacgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgtaatgcggtgttggcgactacggcttcaggtcgtgaaattacttttgttcaagtggccggtttggtggcgcgccgtattttgtgctacacccaagcaggtgcgaaactgtcccgcggcgaacgttatggctttatccgcttcggttcgcgcgtggatatgtatctgcctgtcgatgcgcaggcgcaagtggcgattggcgataaagtaaccggcgtcagcactgtattggcgcgtttgccgctgactgcgccgcaaactgaatctgagcctgaatctgagcctgctttacaaactgctccggttgaaacagcggcaaacccatctgccgaacaacggcaaatcgaggcagcggcggctaagattcaggcggctgtgcaagatgtgttgaaagattaattttgcggactgaaatagaaaatatcagtaccatcattcacacgaatgaggaagtttggttttttgaatttttgctaatgttcacaccgtcattcccacgaaagtgggaatctagaaacttaacgttacgacgatttatcggaaacgactgaaaccggacggactggattcccgcctgcgcgggaatgacgacttattagttacctaacacttaaaaaacagaaacctttccgcgtcattcccacgaaagtgggaatccgggaacttaacgttacagcgatttatcggaaacggctgaaaccgaacgaattggattcccgcctgcgcgggaatgacaactcattagttacctaaaacttaaaaaacggaaacctttacgccgtcattcccacgaaagtgggaatccgggaacttaacgttacagtgatttatcggaaacggctgaaaccgaacgaattggattcccgcctgcgcgggaatgacaactcattagttacctaaaacttaaaaaacagaaacctttacgccgtcattcccacgaaagtgggaatctagaacccaaatgctaaggcgatttatcggaaacggctgaaaccgaatgaattggattcccgcctgcgcaggaatgacaactcattagttacctaaaacttaaaaaacagaaacctttacaccgtcattcccacgaaagtgggaatctagaacccaaatgctaaggcgatttatcggaaacggctgaaaccgaatgaattggattctcgcctgcgcgggaatgacgacccattagttacctaaaatttaaaaaacagaaacctttccgcgtcattcccatgaaagtgggaatctagaacccaaatgctaaggcgatttatcggaaacggctgaaaccgaacgaattggattcccgcctgcgcgggaatgacgggatcttgggtttctgcttttgatttttctgcttttgcgagaatgacggcgtgaaagtaagaatgatgaaacaaaaaaaatgggaatgatggcatagtggtttgttctttgtctttgccatatttcctaacaaattgattaaaaagaaaaaaggttttcagaatgccgtctgaaaaccttttttgtttgcctgtccgattttaaaacttcacgttcacgccgccggtaaagctgcggcccatttgcggcgtatcagagagaaagctgctgtgggcgtaaacggattggttgagcaggttgtcggctttgacgtaccaattccactcgccatagcgcgtattgcggcggtagtttgcgccgaggttgagcatatggtgtccgggcgtgcgcgtttcgtagcgggcgagtttgttttgggcgaacacgcggtagtagtccaaattggcatcgatacggtcggtcagcgaggctttcaggtggaagccgaggcgcgcagccggaacacggggggcattttggtcgtcctgtgcgatgaaaggacggttgccgtaggcatcttctctgccgggtagggaaggcaggtttttcagacggcctcgtacatagtcgccggaaacgccgatgcggtagcgsggtgtcggtttgaagtagatttcgccttccgcgccgtagaagtcggcgccggattggttgtagcgcacgagcttcatttcgctgtcgtcttcgatggatttggggccgcgtccgtcgtttaaggtttgggcgtaaatgtagttaccgaagcggttgcggtagagtgccagattgtattgccagcggtcgccttcgtagcccagcgcgagttcgatattgttggaacgctctttgttgaggtgtttgttgccgacttcaaaggtgttggtggcgacgtgtttgccgtgtgcgtacagctcttgcgttgacggcaggcgttcctgatgggaggcggtcaggctgagtttgtgttgtggcgtgaaataccagttgcccgaaagtgcgaatgagcgggcggtttggcggtgcgcgccgaggtcgggcagggggtggttgtagtagttttcccgatcaatcaatgctttgtcgtactgaatggaggctttttgtttttccacgcgtacgcctccttcaagcgtgaagttgtcccagtttgcctgttctacaccgaaaaagctgtaatgttgcactttgttgtcaagcagcatcggttgtttaaccgcttcggatatggcagataaagcactggatttttgttgtaaatattgcacgccccagctgcctttcagacgacctatgggttggtggcgcaactcgatgcgggcgttttgcgtttggttgttaaaaaagttttcgactgcatcgcctgctttttcgtcgtggcggtagtcgttgcggttcaggtgtacgcgcagggcttcaaaaccggggaacggttgcttccattcggcacggagttcgtagcgtttgttgcgcaggtctatccacggtctgccgctgtgggtgtgtgcgtgtgcattatcgtcgtcgtggaagccgcagctcaagcccggattgtcgtaatcgatgtcttcttcggtcaacaggtgcggataaagctgtaaatagcgtttgttaatcaagctcttttgccagatgatgtcggcgtggcaatcatcgtattcgtggctgtgggcaggcagaccatattggtcgcgacggtcgctgtacgctacgccgataaaacctttttcgccaacccaagacagcccgatgctgcccgtttgcgaatcggcgtggctgtcgggcaggcgtttcagattgcggtaacgcggtacggcgtaatcccccgatttgcggtacagcccttccgtgtgcaatacaaagtttttgcccaaaccgatattgatgccgccggacgtgagtttttccagattgccgctgctcaaacgcaatccgagttcgcccgatacgccgttttcaggcattttttcggggattttgccatcggcaacatcgaccagccccgccacattgcccgagctgtacaagagcgtaaccggcccgcgcaggatttcgacctgttgcgacaaggcggtatctaccataatggcgtgatcgggcgaaaaatccgccatatcgcctgtttcgccgtgatggttcaacactttaayccgcctgcctgtttgaccgcgaatgacgggagcagacgcgccgccgccgtattgcgaagcgtggatgcccggtacgccgtctaaagcgtcgcccaagttgacggctttttggcgcaaggtatcgccggagatgattttgtcggaggcggtcgaagtgtgcaacagccccgacgtggcgcgcggacggcttttgccgacgacgctgaccgtttccaaatccaccgattgctcagtttcatgcgcttgggcgaggaggggtgtgttgattaaaagaattgataaaacaatgggtttgagtgtagtttgtgccattttggcttctcgtcgcatttcaaaagtttgttattatataacattacattttttatatcataagattttgagaacactcagagggcataggcaaaagtttttcaaatgaaacggttgcggcatcgggcggtgtccatttgtatccgccgtccttcgggggcgcggttgatgttgacgcagattccgctgtgtttgcccattatgttcggctgcgggataaccaaaatttatgagtgcataaaaacggcacgttcccgaacggtcgaaaaggtggcaaaatggcgtacttgtcagaacgcgaggctctgcgccaggttcacgagggcgcatcgggcacgctaagatataagagggtatggatgggggtatcggaaatgcagttaataacaaacaaattataaatcaataggttaatcacaaaatgcttttgtttatcgacaattacgacagttttacttacaacatcgtccagtatttcactgaattggggcaggaagttgccgtgcgccgcaacgatgatattacgttggaggaaatcgaggcattgaatccgcaatatctcgttatcggccccggcccgtgttcgcccaaagaagcggggatttccgtggcggcgatgcgccatttcgccggccggctgccgattatgggcgtgtgcctcgggcatcagacgataggcgaggcgttcggcggcaggatagtccgcgccaaaacgctgatgcacggtaaggtgtcgcccgtgtcccattcgggcaagggtatgtttaagggtttgcccaatccggttacctgtacgcgttatcacagcctcgttatcgatcggaatacgatgcccgaatgtttggaagtaacggcttggactgaggacggcgagattatgggtgtgcgccataaggaatatgccgtcgagggcgtgcagttccaccccgaagccctcttgaccgagcacggacatgatatgttaaacaattttttaatcgaatttcaaaacttcaaaccgcaaaaaatctgacgtgatgccgtctgaagcccttcagacggcattttcgtccgaatattgaacggaggacaaaaaatgattacaccgcaacaggccatcgaacgattaatcagcaataacgagttgttttacgatgaaatgaccgacttgatgcgtcagattatgagaggacaggttctgccggagcagatagcggccattttgacaggattgcgtatcaaggttgaaaccgtttccgaaattaccgcagctgcagccgtcatgcgcgagtttgcgacaaaagtgccgctggagaatgcagaggggctggtcgatatcgtcggtacgggcggggatggcgcgaaaaccttcaatatttcgacgacttcgatgtttgttgccgcagcggcaggcgcgaaggttgccaaacacggaggccggtcggtctcttcctccagcggtgcggctgacgtggtggagcagatgggcgcaaacctcaacctgactcccgaacaggttgcccaaagtatcaggcagaccggcatcgggtttatgttcgcgcccaatcaccacagtgccatgcgccatgtcgcccctgtacgccgttcgctcggtttccgaagtattttcaacatattgggtccgttaacgaatcctgcgggcgcgccgaaccagcttttgggcgtgttccacaccgatttgtgcggcattttgtcgcgggtcttgcaacaacttggttcaaaacacgttttggttgtttgcggggagggcggtttggatgaaattacactgacgggcaaaacacgcgttgccgagctcaaagacggaaaaatcagcgaatacgacatccgcccagaagatttcggtatcgaaacccgccgcaatttggatgaaatcaaagttgccaatactcaggaatctttgttgaaaatgaatgaggtgctggaaggaagagaaggggctgcgcgcgatatcgtattgctcaacaccgccgccgccctgtatgccggaaatgtcgctgcttcgctttcagacggcatatctgccgcacgggaagccatcgattcaggcagggccaaatcgaaaaaagaggagtttgtcggttttcaaccacaacaaagatgccattttcttggaaagatggagcttgggtgatgccgccatgattatggaacttttgtggcaaaacataagcacttcacgaagagaacttaccaaactgtttttatataaaaacttggggctgtactagataaccagaccaaattcccattaactaattgtcttaaaatctgaatttgagattctatttaaaatgccattggcatttctttaaatgcagccccaaatgctctttgggaatgccgttaaacttacgtaaatggctaaattcactaatatcaagcacatcataactacgaaaggtatccgtgtatacaatgccatcaggcttaactttctttcggataattggcaacaatgtcgctgattgcgcattaggaacaacgacggtataaaccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaaagtgtctgcccgaaagacgtttaatcacacaaggaaaccaaaaaatgaacatccaacttcaaggccacatcgtcggcgttaaaaaaatcaacggacaaatcgaaggcaagagcttcgactattgctgcctgattgtcgccacacccttagacagctcccaaggcaacgcattgggcagctctactactgaatacgatttcggcggctctgccaatttcgagcagttccgaaacgcccaatttccgatcgaagcaaacctgaacgtagaaatcgtcactacgggcaaaacccaaaaactgaaagtcatcggttttcaactcgtgaagaaaggctgattgaatgcagaaagtctatgttgtccagtccgtatcaacaggggactttctgtatctctctcctgaaacgggcgacatcggacataccaaattaatcaccaatgccgattatttctacgacttcgaagaagcgattaacgcaggtttggaagaaatcggcaaccaatacgaatttgtcgtattcggatttttgaaagactgattttcggatgttcggcggtcgtctgaaaaacgctccatccattaccgccaaacactttttgaaggaaaatatcatgaaatttattaacacctgccgtaaatacggcgcaaaactggctgttgtaacagctgctcccctggctttggccgcacatgcaaatgcaacgttgcccgatacggcaaaaaacgctttggaagccgcaaaagcggacggtatggaagccggttggattgtagtgggcattttcgccgcgctttttgtattttccatcgttaagagagtgatgaagtaagacggcatgtactaccaagtcggaaataaatgtcttgagaagcaccaggctgaaaacctttatttcagcttggtagtaccaagaatcaaagaaaacggacagattgtcaggccggaatataacggcagcctgtggaagatgtcggacggtcagccgctaaggcttttattggcggaatgcagtccgaaagacaacctgcaaagcggtcttgaaacaggctggatagtattcggcatcctcgcgtccgtttactttgtttccctgctgaaaaaggttttgaaatgatggatttttatttttatctcggcgtttccgtacccgtattaatcggggcggttctgtttaagaattgagcgcatgaagttatggtgtcaaaatcaggctttcaaaacaatcattgaaaggcagaaccatgaacaagccgtttatcactcaggcgcagttggcactttataaatatcagccgtccagcaagtattttgggcaatcgatggcggttatagcgcaatctgaatttgttgaatttgcgaagattaataagtctgaaaatgttattgattgtttctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaagtgcgcctgttgccgcctaaaaggtaccccggatgcctgattatcgggtatccggggaggattaagggggtatttgggtaaaattaggaggtatttggggtgaaaacagccgaaaacctgtgttggggtttcggctgtcgggagggaaaggaattttgcaaaggtctcttttcgtcattcccgccacttttcgtcattcccgcgaaagcgggaatctagaatctcggactttcagataatctttgaatattgctgttgttctaaggtctagattcccgcctgcgcgggaatgacgatgcaggtatttctgacgattcccggctatgatgttgaggcagaaatcgaaaaattcgtttggatggatgctgtgatttggcagatgccgggctggtggatgcacgagccttggacagtgaaaaaatacatagacggagtattaaccgctggacacggcaaactctaccaaagcgacggcagacacagcgtcaatccgactgagggctacggcacaggcggcttgttgcaaggcaaaaaacatatgctttcactgacttggaatgcgccgattgaggcgtttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaattaaaaatccatcttcaacacggagatggattttgtttgtttcgttgattttgtgtcagtttcagatgtaggtgcttattcggacgggccgtctgaaaatgtttgccccaatgcaaaaaaatcactgcaaaccttcataaacggggtttgcagtgattttttcaaatcaaacagattgaaaacctgcgccgaattgttcagacggcattattttttcagttcggacagaatgtcatctacggttttcttcgcatctccgaaacacatcacgctgttttcgttgaagaacagtgggttttgtacacctgcgtagccggtattcatcgagcgtttgaagacgacgacttcttttgccttccacacttccaacacgggcatacccgcaatcgggctgttcgggtcggtttgggcggcggggttgacggtgtcgttcgcaccgatgaccaagaccacatcggtttcggggaagtcgtcgttgatttcgtccatttccaaaacgatgtcgtaggggactttggcttcggcgagcagtacgttcatatgaccgggcaggcggccggcgacggggtggatgccgaagcgtacttcggtgccgtttttacgtaaaagctcggtgatttcggcaacggggtattgcgcttgtgcgactgccataccgtagcccggggtaatgatgacattgtttgcgcctttcagcatttcggcaatatcggcagctttgacttctcggtattcccctatctcttggctgccggaagataatgtgccgctgtcgctgccgaaaccaccggcaattaccgagacaaacgagcggttcatggctttgcacataatgtaggacagaatcgcgccgcttgagccgaccagcgcgccggtaacgatgagcaggtcgttggagagcatgaagcctgccgctgcggccgcccagccggagtaggagttgagcatggacacgaccacgggcatatctgcgccgccgatggaggcaaccaagtgccagccgaatgcgagggcaatcagggtcataatcagcaggatgaagccgctgccgtcaatgccgacaaatacgagcagcaacacaaacgatacggcaagtgccagtgcgttgagcttgtgtttggcgggcagttgcagcgggctgctgctgattttgccgttgagtttgccgaatgcgaccagcgagccggtaaaggttaccgcgccgatgaagatgcctaaatacacttcgaccagatggatggtgtgcatatcgtgcgaaacgttgcccggcgcgatatagctgttgaagccgaccaaaaccgccgctaggccgacgaagctgtgcagcagggcaatcagttcgggcatttcggtcatttccacctttttggctttgtagatgccgattgccgcgccgatgagcatggcgatgatgatccagcccagtccgtgggtattgtcggaaaaaacagttacaaaaagggcgaccgccataccggcgataccggaatagcagccctgtttggcggtttcctgtttggacagccccgccagtgagaagatgaataaaattgcggcaacgatatacgccgctgttacgagtcctgaagacatagaaattctccgattttcgatgatttgttttcaatgccgtctgaaaaattgacgttcgtgttttcagacggcatctgtttcaagcagccgcgacaaacagcccgacggtgcaggcaaatccgcctgcccacatcagtgagcgcatagcggctttgtcggcgatatagcaccagataaaggcgaggcggaacaggatgaacaggcaggcaagcgtgttgatggtcgattgcgccgcattgccggttgcgtgtgccgtcaaaacggcggcggcaaacggtgcaaaggcttcaaaaccgttttgctgtgcggcgtgggcacgggcggctgcgccttgcgtgtgcgctagaaaaccgcgcggattgtggttgtctttaaaccggaatccgcccgcttttttggcatacgccgcacaaaaaagcggcaataggcaggcaatcagaatacaccaataggcgaaagtcatggcttaccctttcttaaacatattcagcatacgccgtgttaccgcaaagccgccgaagatgttgatgccggcaatcaggatggcaacaaacgacagcagcgaaacgaagccgttgccctgaccgatttgcagcagcgcgccgacgacgatgatgccggagatggcgttggttaccgacatcagcggtgtgtgcagcgagtggctgacgttccagacgacgtagtagccgatgacgcaggcgagaacgaacacgataaagtggttcaggaatgctgcgggtgcgaccgcgccgacccacagtaccaagacggcggcgatgacggcgggcgcgagttttttccacaggggaacgggttttggctcgggcttggcggcaggcacggctttttcagacggcgtttgctgcggctgggcggaaacttgaatcggcggaggcgggaaggtgatttcgccgtcgtgggtaacggtcatgttgcggataatcacgtcttcgaagtccaacgtgatttcgccgtctttgttcgggcttaacagcttggtcaggttgaccaagttggtggcgtaaagctgggaagactgtccggcaaggcggtttgccatgtcggtgtagccgatgattttcacgccgttgccggttacggacaattcgcccgggcgggtgagttcgcagttgccgcccgtcgccgccgccaaatcgacgatgacggagccggatttcatgctttccaccatttctttggtaatcagcttgggcgcgggtttgcccggaatggcggcggtggtgatgatgatgtccacttctttcgcctgctcggcaaagagcttcatctcggctgcgataaattcgtcgctcatcactttggcgtagccgtctccgctgccgcccgattcttgtgggaagtcgagtttcaggaacttgccgcccatcgattcgatttgttccgccacttccaagcgggtatcgaacgcgcgtaccactgcgccgagcgagtttgccgtaccgatcgccgccaaacctgccacacctgcaccaatcaccaaaacctgcgcgggcggcactttgccggcggcggtaatttgaccggtgaagaaacggccgaaggcgttggcggcttcaattacggcgcggtagccgctgatgtttgccatcgaagacaaagcgtccaaagcctgcgcgcgcgaaatgcggggcaccatatccatcgccagcgcgttcactttcttggcgcgcaaggcttcgaccaaagcctcgttttggcgcggccacaggaagctgacgatggtttgaccttcgttcaaaagcggcagttcctgttcggacggcgcgttgaccttataaatcaaagggcagacccaaaccgccgctttgtcggcaacggttgcgcctgctgtttggtaagcggcatcgtccaaacttgccgccaaacctgcaccgctttcgacaacggtttcaaagcccagtttgcccagcagggcgacggtggcgggcgtacaggcgacgcgggtttcgccggataatgactcgcgtgggataccgattttcatctctgaatcctttttcgggttgtttatatgtatcgtgggttaaatttaaatcggggcggggcggagcaacgccgtaccggtttaaagccgactcacttcaaatgttaatatattttagataatccccttataacgaattttcatcaggctggcaatagttgcggcattttcccgtgttgtccgacacatactgccgtttgtgtttgaaatcgttttccgattgcagtcccgcccgccgtaacattctttgccgtttcactatataatccgcattttttgagccgccgttatgccgcacgccctcgtcctccaatttccctccgccgcagccctgccttccgacttccccttacgcctgcccgaacctgattgcgccgatgaaaagcgtatgcgttttatcgttgaagaagggttttctttaagcgaaaaagacgcggcgttgcttggcagccgtcaaatcgaccacgccgtgttgccggatatggatttcgacgaactcggtttgattgtcagcgatatggattcgacgctgattaccatcgaatgcgtcgatgaaattgcggcaggcgtgggtttaaaaaacaaagtagcggaaattaccgagcgttcgatgcgcggcgaactcgatttcgaacagtctttacgcagccgcgtcgcgctgttggcgggattggacgaacgggttttggcggacgtttatgaaaacgttttgaagctctcgcccggtgcggaatttttgttggacgaatgcaaaaggcacgatgtgaaattcctgctggtgtcgggcggcttcacgttttttaccgaaaggctgcaacaacgcctcggcttcgaataccaacacgccaatgttttggaaattgaaaacggcaggctgaccggccgtctgaaaggcagaatcatcgacgcgcaggcaaaggcagatttgttgcgcgaataccgcagccgcctcggattgcagccgcatcaggtgttggcggtgggcgacggtgcgaacgatattccgatgctcaaagaagcgggcataggcgtggcttaccgtgccaaaccgaaagcgcgggccgccgccgatgcctgtatcaacttcggcggtttggagcgtgtacgcggcctgttcggataggcggataggaaacggatgtcgtccgaaaggttttcagacggcatttgaacggcaggaacgacagtgggacgcagaaaactttggtttgccctggcagcagcgggcgttatcggcggtttggtcggcattgtgctgacggaactgatgcacttcatacagcatacggcatacggttatggcgcggacggcgtgtacacttcgttccgcgaaggcgtggcacaggcttccggtatgcggcgcgttgccgtgctgacgctgtgcggcgcggtcgcaggcagcggctggtggttgctgaaacgtttcggcaagccgcaaatcgaaatcaaagccgccttgaaacagccgttgcaggggctgccgtttctgacgacggttttccatgttctgctgcaaatcataacggtcggactcggttcgccgctcggacgcgaagtcgccccgcgcgaaatgaccgccgcgtttgcttttgccggcggcaaacgcttgggtttggatgaaggcgaaatgcggctactgattgcttgcgcttcgggtgcgggtttggcggccgtgtataacgtgccgctcgcctccacacttttcattctcgaagccatgctgggcgtgtggacgcagcaagccgtcgccgctgcattgttaacttcagtcatcgccaccgccgtcgcgcgcatcggcttgggcgacgtgcagcaatatcatccggccaaccttaccgtcaatacttcattactttggttttccgccgtcatcggcccgatactgggcgtagccgccgtctttttccagcgtaccgcccaaaagttcccctttatcaagcgcgacaatatcaaaattattcccttggccgtctgtatgtttgcactcatcggcgtgatttccgtttggtttcccgaaattttgggcaatggcaaagcaggcaatcaactgacctttggcggattgaccgattggcaacacagccttgggctgaccgccgtcaaatggctggtcgtcttaatggcgcttgccgtcggcgcatacggcggtctgattaccccgtccatgatgctcggcagtaccatcgcctttgctgctgccaccgcgtggaacagtgtttttcctgaaatgtcctctgaaagcgcagccattgtcggcgccgcagttttcctcggtgtttcccttaaaatgcccctgaccgccatagcctttattttggagctcacctacgcccctgttgccttgctcatgccattatgtacaggcatggcaggtgcagtatgggtggcaaagaaaatgggatttaaataggcaaaagcaaaaggccgtctgaaaccaagtttcagacggccttttacaataaaattgttaacaatatttgcaaaaacctactgccaaaaatgcgaaactgggggataataccgccctgaaaattcatcccatactgattaaaccttcaacaaaggaaatccaaatgtcttccatcaaacgcgccctgatcagcctatccgacaagacaggcgcagtcgaatttgcccaaaccctgcacaaactcggtgtcgaaattctttctaccggcggtacagcaaaactcttggctgatgcaggcgttcccgttatcgaagttgccgactataccggttttcccgaaatgctcgacggccgcgtgaaaaccctgcatccgaaaatccacggcggtattctcggtcgtcgcgatttggacgaacacgtcgccaagatggaagaacacggcatcggcaatatcgacctcgtgtgcgtcaacctctacctcttcgctgccaccatcgccaaaccaaactgcacgctggaagacgcgattgaaaacatcgacatcggcggcccgaccatggtgcgctctgccgcgaaaaactggaaacacgtcgccatcgttaccgacaccgccgatttcccggccatagctgccgaactcgaagccaacaacggcgcattgagcgacaaaacccgtttcaacctctcgcgcaaagcattcagccataccgcccaatacgacggtatgatttccaattacctgacctcgctttcagacgacgtcttgagcggcacgcccgaaatcgccggattccccggccggttcaatcaaagctggattaaagtgcaagacatgcgctacggcgaaaacccgcatcagcgcgccgcgttctaccgcgatattgaccccgccgcaggcagcctcgctgcatacaaacaactgcaaggcaaagaattgtcttacaacaacatcgccgatgccgatgccgcatgggaagccgtcaaatccttcgacgtgcccgcctgcgtgattgtgaaacacgccaatccgtgcggcgtagccatcgcctccaataccttggatgcctacaaactcgcctacgccaccgacaccaccagcgcgttcggcggcatcatcgctttcaaccgcgaagttgacggcgcaaccgtcaaacaaattaccgacaaccagtttatggaagtcctcatggcgcctaagttcaccgccgaagccctcgaaatcgccgccgccaagaaaaacgtgcgcgtattggaagtgccgcttgaggcaggcgcaaaccgcttcgaactcaaacgcgtcggcggcggactgttggtgcaaacgcccgacatccaccgcatcagccgcgccgatttgaaagtcgtctccaaacgccaaccgaccgagcaggaatggaacgatttgctgttcgtctggaacgtcgccaaatacgtcaaatccaacgccatcgtattcggcaaaggcggtcaaacctacggcatcggcgcaggccaaatgagccgcgtggacagcacccgcatcgccgcccgcaaagcgcaagatgccggtctcgacctcaacggcgcgtgtgccgcatccgatgccttcttccccttccgcgacggcgtggacgtgattgccgaacagggcatcaaagccatcatccatccggcaggctcgatgcgcgatcaggaagttttcgacgcagccgacgaacacggcatcgccatggtcgtaaccggcatccgccatttccgccattgatgcagataaacaaggtaatgccgtctgaagggctttcagacggtattttgcgctattttgcgaaggtagggatgacggttcgggtattcctgacagggtggattttcaaggtgttgtatagggtgtaggaggattcgtaaaaggtgggatgcagggtgtgcttcagcccgctgcatcaaaaatttttggagaaccggcgggagtcggcggttttggtttcggcggggacggtggaaatgggtaacattgacggaatcgacggaagcggtggactgaagcccacccttgtatattggaatcaccgtatcatagcaacaaaccgcccagccgccacccgcgcccacccaaggcacacaaccgttgcgtagctcagggagcggcagggcaacccatcgacacaaccggacagttgccggacaacacaaccgaatgcaaggcaggtttatgatgagtacccaataccattacgcaggtatagtgaattaaatctaaaccagtacagcgttggttcgccttagctcaaagagaacgattctctaaggtgctgaagcaccaagtgaatcggtttcgtactatttgtactgtctgcggctcgccgccttgtcctgatttttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgccctcgtcgtgacggaaagtaccggcggtctcgaaatccccgccgccaaagccatccgccgagcagggccgtgattatcgccaacccgcgtcagacgcatcagtttgcccaatcgcagccgctgaccaaaaccgacgccaaagatgccaaaatgcccgccttcttcgcacagatgacggcacagaaagaagattcgcaaaccatgccctaccacccgcccaccgaagtggaagaagtgttggaagccttggttaaccgccgcaaccaactggtggatatgcggactgccgagaaaaaccgtctgcattaggttcatgaaacgcaagtcgaaagcgtcaaacaactgattgcccattttgaccggctgattgacgaattggacaaacaaatcgacaaccacacccacacgcattttgacggcaaagcccaagtggcagagcaaatcaaaggcatcggttcgataacgacggctacgctgatggcgatgttgcccgaattggggcggctgtcgcacaaacggatagcgagtctagtcggcattgccccacacccgagggagagcggggaaaccaaattcaaaagccgctgctttggcggaaggtctgcggtgcgtaaggcactgtatatggctaccgtggcagcgacacgttttgaaccgcttattcgggatttctaccaacgcctgccgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgcttttttatgtctgtccgtttcgcaaaaaacatcggcttaatactatatattgtgttttatgggtttgagatgcgccgggcgttgattgcgaaaattaagattgctcaaaaggagctgggcttggatgacggtacctatcgcgcggtgttggagcgtgtgacgggcaagcggtcgtgtgcggatatggatgtttccgaacttgagtctgttgtcgctgatatgcggtcgcacggatttaagcctaaagcaaaaggtaacccacacggcaaaccgcatctgcgtcggacatcatcagcggcaatgttggacaaagtcgaagccctgctgaccgtcggcggcaaacattggaactatgcacacgcaatggcgcggcggatgtttggtaaggataaggtcgaatatttagacgatacgcagctacataaactggttgctgcgttgcagattgcggaaaacaggaaaacggaaaaagcgggtggggatgatggggttcgaaaaagttgaacatttattgccggataccgtgttggacattgtggatgtcatcggactggcagcgacggaacagctggtcaaggcgattggcggggcgcggtttaaatttggtaagggcaaggtggacaccgagcgtttggcaattttggtcgaagccatcggcgaagtgaaaacacatgagctgttgcaggtatatggtggcgaggaattgtatgtcccacggtgcggcaaggcgttaatacagttgagaaaccataggttttatcaggagtttgtcaaattgcgcgatattgataagaagagcgggcttatggcgatgacgaagctatgccctaaatacggcatctcttcacgaacgggatatacgattatcaatgaaatgagccgacctgcggcacagcaggcagctttattttaggcagtgatgtgtgaccaggctttggccgtctgtattcagacggtcttttttttggtttgcaggggtgaaacatctaccgttcgggacgatgggttaaagacggtttaatggggttttcaaatgttatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatgcaatcaatattttttggagatgatgaatgggcaaaaccgtaaccttaaccgctggacacagcaacaccgacccgggtgcggtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgcttggtttgcacttccgacagcgggcggttgcggcaggctttgctcataatgccgtccaacaactgatgttcttccagatgttgccggttttccgcactgtcatagcctttatcggcatagacggtcgtaccttcgggtaacccttccaacaacggcgacaggtgtttgcactcatgggcattggcgggggtgatgtgcagtttctcgatatagccttccgcatcggtacgggtatgttgtttgtaaccgagtttgtagaggccgtttttcttgatccaacgggcatcgctgtccttactcggtgtggtttggccgctgatttgtccttcttcatcgacttctatggcctgacgctgttcgctgccggcggtctgaataatggtggcgtcaatgacggcggcggatgctttctctacttttaagcctttttcggtcagttggcagttaatcagttccaacagttcggacagggtgtcgtcttgcgccagccagttgcggtagcggcataaggtgctgtaatcggggatgctcagttcgtcaaaacggcaaaacaggttgaaatcgatgcgggtgatgaggctgtgttcgagttcgggatcggagaggctgtgccattgtccgagcaggacggctttgaacatggatagcaggggataggcgggacggccgcggtggtctcggaggtaacgggttttttgacggttcaggtactgctcgatcggctgccaatcaatcacttggtccaacttcaatagcgggaaacggttgatgtgtttggcaatcatggcttgcgcggtttgccggaagaaggtgctcatgagaaatcccctaaatgtcttggtgggaatttaggggattttggggggattttgcaaaggtctcaggcggcaaatcgccacccttcccttcaaaccttccgcctgtcccaacagcagacaggcgaaaaagcccttaccactgataaccgacagatgcggaagcaccgaaatggccgcgcgaattgccggaagccgtgcctttgataatccaatttccgccgtcggaaatactggagtagccgatggcgtaaccggcttcgccgcgataagtgccgccgccgatcgccatcatactcttgccgggcaaatacgcctgaaccagacctgcggttgcaatcgcttgggcgatgcccgcacgcgcgttgccgtccacattgtcgatgcggttgttcaagttttgcgccacgcctttaagttgtgcgacgtttgtaacatccccctctttaacgcccggggcgacattggtaatgcggacgggtttgttgtccttcttgctgccgacattcaatgcgtccccatccacgctcaaagtgggcgcatccgcccccgcgccgagcgaaacgctggaaaactgcggggtcatcgaagtggcgatgtcgatatttttaccgttgcgggtaatctcgatgttgttgccggcattaatgttgacggtttcatccatctttcccttgctcggcgaaacattgccgctgatgactttgcccgaagaacctgcaaccgctttggaatccaaattccaaccgctgttttgcagctgattgacgtttagggcatcgccgacatttacatcatacataacagtgatgttgccttgatcatctttacttacagtcgcagttgtacctttaccactagcaaaggttacatttgtgcctgatgtaacggtttcaaacttgtcagcttgacctgtttgaccattagcggttgttgttttcattctccaaccagccttgtttactgcatcaatcacttcttttgcagtcactaagccttcgccttcgtctgtagaagaaccattctcgcctttgtctttaccagtaaccaacttaccgtctttttctttaataacagaagtcttcgcaccgattttaacttcggttttcttgccgttgtctttgctttccacattaacagtcgttgttttcgtatctgcgctcaagaactcgactgtgtcgtaagtgcggacgaaatcaacgttatcggaagctgttgtaccgggtttaacgcctttaatgttccagccagcgtttaatacgtctttaacgcttgccgcacgttttttctcgtcatcggtaacgttgtcgttggttacgtttgtggtcgctccggtattcagcagcgtatcggtcaaagtcgaaccaataccgttcagatgaaccgtggtgtcgccgttcgtcccagccgtttctttcgcaaaattcaagcctttggtgtcgcttgtgatgttgactttattgccgtttgcgctaaacgataatttttcagttccaacactggtcagatctgtgaggtcttttttcagcgagtaggtgaagtttgtgccgttttgtttgattttcaggttgtcgccggctttgagggtgatttctctggctgttagtactcctttctcgttgaaatatactgcccaatctgaattttcttctactttttctttttctcccgtgccttctttatcggaattgactatcaacacggcaacagtgcgttgtacggggtctaaatataaatcttcttcttgctcttcattgttagcacttgcctgaaccgttgcaaacaacagtgtcgccaatacggcggtcttcacggttgcggaggcgcgtttggtgtggttgcgtgtgagctcggatacgacgacccaggcattgagggcactattccaaatgatgcggtatattttgttcattttgttttttcttttggtttgtttgaatggttaaatcggggtttgggggcggatggtgcggcatccgcccggtttttgggggttgggggttttctgataaattcccccaacttaaaatctcgtcattcccgcgaaggcgggaatctgggacgtggaatctaaggaaactgttttattcggtaagtttccgtgccgacgggtctggattcccgcttttgcgggaatgacggcggtggggtttctgttttttctgatagattcctgtggtttttctatggattcaatcattcctgataaattcccataatctaaaatctcgtcattcccgcgaaagcgggaatctaggacgtggaatctaaggaaactgttttatccggtaagtttccgtgccgacgggtctggattcccgcttttgcgggaatgacggtcggtggggtttctgttttttccgataaagtcctgccgcgttgtgttgctggattcccgcctgcgcgggaatgacggcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgacggcggtggggtttctgttttttccgatagattcctgttgcgttgcgtttttggattcccgcttttgcgggaatgacgcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgatggcggtgggggtttctgttttttccgataaagtcctgccgcgttgtgtttctggattcccgcttttgcgggaatgacgcggtgggggtttctgtttttgctgatagattcctgtggtttttctatggattgaatcattcctgataaattcccataatctaaaatctcgtcattcccgcgaaggcgggaatctaggacgtggaatctaaggaaactgttttatccggtaagtttccgtgccgacgggtctggattcccgctttcgcgggaatgacggcggtggggtttctgtttttgctgatagattcctgtggtttttcggttgctggattcccgcttttgcgggaatgacggcggtggggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacggccgccggacggcaaacgaccatacacaattattgacaaccccatttattgcgaaagtcagcctaggagaatcgatctaattgtcaacattcccttatgatcaaagggattacactttattttacgcaaatgcgggggggggggtgatttttgacgttttttgccgaaaatttacattcggacgacgaaaaggaaaaagccgtgtcgcatctgtgcaacacggcttggcgggcgcaaacggatatagtggattaacaaaaaccagtacggcgttgcctcgccttagctcaaagagaacgattctttaacaagtgaattggttccgtactatttgtactgtctgcggcttcgtcgccttgtcatgatttttgttaatccactataaaacggtgttccctgccgccgcaggcggaacgccggatgacggggttttccctaagggtgcggctgccgctatatcacgaaatccaacaggtagaaatcttctttgcccacgccgcattcggggcatttccagtcgtcggggatgtcttcaaacttggttccgggggcgatgccgtgttcggggtcgccgtgttcttcatcgtaaatccagccgcaggggccgcacatatattgcgccatttgtgtttccttgttttttgtatagtgggttaacaaaaaccggtacggcgttgcctcgccttagctcgaagagaacgattctctaaagtactgaagcacccgtactatttgtactgtctgcggcttcgccgccttgccctgatttttgttcatccgctataaatcagggtttgggagaatggtgcggtatccgcccggtttttttggggttggtttttttcgatagattcctgtggtttttcgattactggattcccacttccgtgggaatgacggtttggaggtttcggttttttcgatgaattcctgttgcgttagggggggggctggattcccgcttttgcgggaatgacggtttgagggtttctgttttttccgatggattcctgttacgttgggggctggattcccgcttttgcgggaatgacggtttgagggtttctgttttttccgatggattcctgttacgttgggggctggattcccgcttttgcgggaatgacggtttgagggtttctgttttttccgatggattcctgttgcgttgggggctggattcccgcttttgcgggaatgacggtttgagggtttctgttttttccgatggattcctgttgcgttgggggctggattcccgctttcgcgggaatgacgcggtgggggtttcggtttttccgcctgtttattttgcggcttcgattgccgctatttctttgcgtaggtgtttgatagcgggggttacgatggcaacaaacattgcttcgcggacgcgcctttgggcgggactgcgcatcaggtagccttttgcgccggaatgcagggcggcggattgggcggcggcaagtgccagtacggcggcggcttcgcgcagcttgagggtagcaaggttgtcgggcgtgccgctccaagccaagccggcgagccgttcggtttctgcccacgcgccgtccagccttgttttgaggctgtcgtagccgtcgttgaggtagttgttgacttcggcgttgacgacgttggcgaggcggatgatgccgaggctgccgtcgattacgcccgcgccgatgccgatttgcaggaggataaagcctgctttgatgctttggatgtagtcggcaaactgttcgggcgcggcgatgatgtcttcgtcggggataaatacgtctttgaaattcaggctgaaggtgcgcgtaccttcgagggcgcaaaattcggggcagttttgcaggcttacgccttcccattgtccgcctgtgatgaacataacgtagccgtcgccgatttgggcggtattcgcccagatgtggtcttcaccgatgttggacacccacggcagcgcgccgttgactgtgtagccgccttccacgcgttcggcttggaggttgtgtttttcgatgtcggcaaggtgtttgacggtattggacatgcccgtacccgccaatactttgccttgcaggatgtcggcaaggtatttgtctttgacggcccggttgggcgtttggtgcagataccacgcgcaagccgcctgacaccacgcactgaaagaggttgcgccgcattctttgccgatttcgcgcaatacggcgatttgcgttgccaaacccaagccgttgccgccttcggcttctgtaccgactgcgccgaatccaccgattgcgccgagttcgcgcataaatgcttcggggtagtatcctttgcggtcgatgtcgtccactatgggtttgagcttggttttgacgaattcggcaacgttggcaatcagggtttgggcgttcatctttgttccttaaggtttgcggggaaatcgggggcgcgcctgatgcgcggctgcttccctgccgcttaggcggcttgtttttgtttgagggggtgtttttgaaaaaccgcccgatattcgggcggtttgccgtatcaggcgtaagcctgcaattcggggttgatttcggtttgtccgaggttgttgacgtagttgcacagggttgccaaggctacgcccatcacgacttcgactgcctgctgctggttgtagcccgcatcgaaaaatgctttgagttcctcgtcggataccgcgccttttttcgccattacggcttgggtgaaggcggcgagcgcgccgagtttggcatcgtcaaattcgcctgctgccaaagcgcgcgcggctttgacggattgttcggacaggagttttttcagggttgcgagtttggtgtgccctgccacgcaaaaaccgcattggttggtacgggcggcgatgatctggatgacttcgacttcgccggcggtcaggctgttggcggcgttgagcttgccgacttcttggtaaaacgccaaggcttcgggggcgtttgataatacgccgataaggttggggataaagccgttgttttgaagtaccgcctcgacgcgcgctttggcggcttcgggggcggtttcgagggtgtgtacggttaaacgtgccattttctttccttgttcgcaaatattgggtacgggcgcatggtatgcatttcggaacggaataggaaagactgattggttatgtgctgcaaacaaaaggttataagaaatgccgtctgaacatttttcagacggcatgatggaaaagaaaacgcgcttatcggcccccgcgcccgaaatattgcgccaatgcggcttggggattggctgcctcaaccgtttcgggcaattcggtatagccgcgcgataaaaggtggcgtgcataaaggctgttgccctttgcgccgaaccagacggaaaccgccaagcccaatacgttaaacgccgagtctgtggcgggcgtgtcgccgtaaaccagttgggcaaacacagccagcacgaatatcgcgcccgtcagccccagccccaaaccccacattcttttgaaacacgcccacagcgtgccgaacaagagccccggccatgaccagccttgtttgacggcttggggcggcagggcgggatgggtgtagattttgtatggtttcatcgtgtttccttttcggttgaaaccctgccctttgggaaggtaggatcagactttatagtggattaaatttaaaccagtacggcgttacctcgccttgccgtactatctgtactgtctgcggcttcgttgccttgtcctgatttaaatttaatccactatatttgggaggcgcgcgcgcctgtgccggcatacggcttgaaagcgattacccgatggggaacttcaaacccgacaatgccgtctgaacggtgtcttgccttcagacggcattgcctgccttcaaagcggacgcgcttattccgcccagtttttctttttgctggttttgcctacgcccgggttgaagctgttggtcgggtcaagtttgcggtaaaactgtttgagcgcgggcttggcttcgtacaaatggccgacgttgtgttcggctggatattgcgcgccgcgttgatccaagagatgcagcatttcgtgttccaatgccatgcagtcgttgccttttttgatgatgtaatcctgatggaaaacgtggcacatgaaatgtccgtagtagagcttgtggatgattttattgtcgatttccggcggcagtttttcaaaccagtcgcggtcgtcgcggcgcagggcgatgtcaagcgcgaccaagtcctccacttcgtcgtcgtgtacggcacggtagcggatggcggctgaggcgacggcgaaacggtgcagcatcgcggcttgggtttcttcggcgttgcactcgaaaaacgcgccgccgtgatgtgcaaaatactctttcaggaacgcgcgcgcctcatccacgccttttccgcccattttcagaatcaggtggtgttcgtatttgtcgcggtaatcgcgcatggatttgggcagatggtcaggcaggaatttgctgacgaactgcattgccttgtcggaaaaatgtttgggcaggaagctgacttttttgccgaacctgtccacgcgtgccttcaaatcaaataatttcggcagttggtgcgtaccgaattttttgatgacgtaaaacgtatctttgccgtacacgtcggcaatgtcgaaagcgtggcggtggatgtattcgccggaaacgggcaggctttcaaattcgcccaaggcggcgcggcggatgtcggtcagctcgttgatgtcgttcgtgccgatgtagaacacggccgtttgtttttcttgcggaaaggtatccaagcggacggcgaataccatcagcttgcccgcgcagcccgaggcttcgtaatggcgcgctgggtcggcattgaaacgcgcggcggtcggttcgtccacttggcggacatgttcgcaataggcgtggtcgtgtcctttgcccgcgtcttgcgtgatgtctttgttttgataatgatgaccttgaagattggtcaggatttcttcgggcgtgttgcccaagtctatgcccaagtggttgaccagttccaacctgccttcttcgttgatttgggcgaacaacgccatttcggtgtaggccgggccgcgctgtaccaacgcgccgccagagttgttgcacacgccgcccaagacggacgcgccgatacaggatgagccgataaccgaatgcggttcgcgccccaaaggtttcagcagcaattcgagctggttcagggtcgagccgggcaggcagacgacttgttcgttgttgttgatggtttggatgatgttcatccgcatggtgttcacaatcacgatgtcgcggtcgtaatcgttgccgtcgggggtcgagccgcccgtcaaaccggtattcgccgcctgcgtaatcacaatcacgtctgcttcgacgcacgcctgcagaattttccacatttccagaatgcttccggggcgaaccaccgccaacgccttaccctcgccgaagcggtaaccttggcggtattgttcggttttcgcggggtcggtgatgatgtatttttcgcctacggtttgggtcagtcttgacagtaattgtgatgcgctcatggcagtttccttaaaattgtcggcaggtgcattgcacattggaattgttttcacattgtagttatacgttatggcaaagtaaagaaaatgccgtctgaacggctttcagacggcatcggtgcgatacgggaacgccggaacatcgaagctccggcgtttcaaatagggcggcgggccaaacccccggcactggcgcattggagtgggctgctggcttccgcccctgacccggtgttccgatttgccatgcggggagacccgcctcagagaaacggcattataacgggttttctgaaaaactcaaccgttttgatacggtcatacgccggaaacaccacctaaaatttatatttgataatattgtcaacaatttctcaaagcgttattttgtttctataagggtatttcctgtttcggcattgaaaagtatcaaaaattgaactacattatcgccttttcaaactcgcctgaaaccgacttttcagacggcattcaaataaaaactgccaaacacggacacaccatgaccacgactaccgcccctcagcgtattcgggaaatcccctacaactatacttcctacaccgaccgcgaaatcgtcatccgattattgggcgacgaagcgtggcaaatcctgcaagacctgcgcggtcaacgcaaaaccgggcgttcggcgcggatgctgtttgaagtgttgggtgatatttgggtggtcgtgcgcaatccgtatctggtcgatgacttgctggagcacccaaaacgccgcgccgcgctggtacgtgaaatgcgccaccgcttaaatgaaatccgcaaacgccgcgacgataatcggcaagtggatgtgttggttgccgcagcagaaaaagcagtcgagcgttttgatagcagttttgatgaaaccagccaaaaacggcggcagattttggagcgtttgagcaaaatcaccaagccgcacaatattatgttcgacgggctggcgcgggtaacgcacgttaccgatgcaaccgactggcgcgtggagtatccgtttgtcgtcgtcaatcccgacacggaggctgaaatcgcgcctttggtgcgcgccttaatcgagctggatttggtcattattccgcgcggcggcggcacgggttataccggcggcgcgattcctttggacgcaaacagcgcagtcatcaataccgaaaaactcgacaagcatcgtggtgttgaatacgttgagctggcaggcttggacggcaagcatccgattatccggtgcggcgcgggcgtggttacgcggcgggtggaagaaaccgcgcatcaggcaggtttggtgttcgccgtcgatccgacttctgccgacgcgtcatgcgtgggcggtaatgtggcgatgaacgcgggcggcaaaaaagccgtgctgtgggggacggcgttggacaacctcgcctactggaacatggttaaccctcaaggcgaatggctgcgtatcgagcgcgtgcgccacaatttcggcaaaatccacgacgaagaaaccgccgtgttcgacgttcacacgctggattcagacggcatcaatatcgttaaaaccgaacgcttggaaatccccggccacaaattccgcaaagtcggtttgggcaaagacgttaccgacaaattcttgagcggcctgcccggcgtgcaaaaagaaggtacagacggcatcatcaccagcgttgccttcgtgttgcataaaatgccgaaatacacgcgcaccgtgtgtatggagtttttcggtacggtcgccaccgccacgccatctattgtcgaaatccgcgactttttgcttgcccatgaaagcgtgcggctggcgggtttggaacatttggactggcgttatgtccgcgccgtcggctacgccaccaaagcggcgggcaagggacgaccgaaaatggttttgctggcagacgtggtttcagacgacgaagccgccgtagaggcagccgccgaacacatctgtgaactcgcacgcgcccgcgacggcgaaggctttatcgccgtatcgcccgaagcccgcaaaaccttctggctcgaccgcagccgcaccgccgccatcgccaaacataccaacgcctttaaaatcaacgaagacgtggtcatcccgctcgaaaggctcggcgagtattcggacggcatcgaacgcatcaacattgagctttccatccaaaacaagctcaaactctgtgccgccttggagcaatatctttcgggcaaactccccatcgacaaaatgggcactgacctgccgaccgccgaactgttgggcgaacgcggcaaacacgccctggcccacgtttccgccgtcaaaacgcgttgggaatggctgctcgccaatcttgacacgccgcttgccgactacaaagcccgctacggcgcagccgtccacgccgcacccgaagccaaaaacaatgaaagctgctttattgccttccgcgatttccgcctgcgcgtgtctgtcaaagcggacgtaatgaaaccgctttctgaaatcttcagcggcaaaaccgacaccaaaattatccaaggcttgggaaaaatccacgcaaaaaccgtacgcagccgcgtctttgtcgccctgcatatgcacgccggcgacggtaacgttcacaccaatattccggttaactcagacgatgccgaaatgcttcagacggcataccgctcagtcgaacgcattatgaaaatcgcccgttcgcttaacggcgtgatttccggcgaacacggcatcggcattaccaagctcgaatttttaagcgacgaagaaatgcagccgttttgggactacaaaaaccaagtcgatccgaaacacaccttcaaccgtcacaaactgatgaaaggctcggacttacgcaacgcctacacgccgtccttcgagctgttgggcgcggaatcgctgattatggaaaaatcaaacctcggcacgattgccgattccgtcaaagactgcctgcgctgcggcaaatgcaaacccgtctgctctactcacgttccgcgtgccaacctgctgtacagcccccgcaacaaaatcctcggcgtgggcttattgatcgaagccttcttatacgaagaacaaacccgccgcggcgtttccatcaaacactttgaagaactcatggacatcggcgaccactgcaccgtgtgccaccgctgcgtcaaaccctgccccgtcaacatcgacttcggcgacgttaccgtagccgtccgcaactatcttgccgattccggccacaaacgatttgcgcctgccgcagctatgggtatggcgtttttgaacgccaccggcccgaaaaccatcaaagcccttcgcgccgccatgatacagatcggcttcccagcgcagaatttcgcctacaaaatcggcaaacttcttccaatcggcacgaaaaagcaaaaagccgaacccaaggcaaccgtcggcaaagccccgattaaagaacaggttatccatttcatcaaccgcccactgcccaaaaacgtacccgccaaaacaccgcgctccttattgggcatcgaagacggcaaaagcatccccatcatccgcaaccccgccgcgcccgaagatgccgaagccgtgttctacttcccgggttgcggctctgagcgtctgttcagccaaatcggacttgccgttcaagccatgctctggcacgtcggcgtacaaaccgtcctgccgcccggctatatgtgttgcggctatccgcaagacgcaggcggcaataaggcaaaagccgaagaaatgagcaccaacaaccgcgtggctttccaccgtatggcgaacaccctcaactacctcgacatcaaaaccgtcgtcgtcagttgcggcacttgttacgaccagctcgaaaaataccgctttgaagaaatcttccccggctgccgaatcatcgacatccacgaatacctgctcgaaaaaggcgtgaaactcgacggcgtaaaaggtcagcaatacctctaccacgacccctgccatacccccatcaaaaccatgaacgccacccaaatggccagcagcctgatggggcagaaagtcgttttaagcgaccgctgctgcggcgaatccggtatgtttgccgtcaaacggccagacatcgccactcaggtcaagttccgcaaacaagaggaaatcgagaaaaacctcaaagagctgccgcagggcgaacccgtcaaaatgctgacctcctgccccgcctgcctgcaaggcttgagccgctacgccgacgacaacaatatgcctgccgactacatcgtcatcgaaatggcgaaatacatcctcggcgaaaactggctggatgagtttgtaaaaaaagccaacaacggcggtgtagagaaagtgttgctgtaacaacggacacggaaatgccgtctgaacgccgaaagccttcagacggcattgtttgaaccaaatatagtggattaacaaaaatcagaacaaggcgacgaagccgcagacagtacaaatagtacggcaaggcgaggcaacgctgtactggtttaaatttaatccactatacctacccaaatcatgattgacagacaaacaaacgaacccaaacaaaaaacccgaatcatccttgcccctatgcagggtctggtcgatgacgtgatgcgcgacctgctgacgcgtattggcggctacgacgaatgcgtcagcgaatttgtacgcattacccataccgtgcattcccgatccatatggttaaaatatgtccccgaaatcgccaacggaaacaaaacgttttccggcacgccttgcaccgtccaacttttgggcagcgatgcggacaatatggcggcgaatgcgctggaagccgtccgcttcggtgcgaacaaaatcgatttgaacttcggctgccccgcgcccaccgtcaacaaacacaaaggcggcgcaatccttttaaaagagccggaactgatattccacatcgtcaaaacgctgcgcggacgtttgcccgcacatattccgctcaccgcaaaaatgcggctcggttacgaagacaaaagccgggctttggaatgcgcctgtgcgattgccgaagggggcgcatgcggactgaccgtacacgcgcgtaccaaagccgagggttacgaaccgccggcgcattgggaatggataaggaaaatccgagacagcgtcaatattcccgttaccgccaacggcgacgttttcagcctgcaagactatatcggcatcaaaacaatcagcggctgcaacagcgtgatgctcggtcgcggcgcggtcatccgccccgatttggcgcggcaaatcaagcaatacgagaacggcgggccggtcaaagacacggattttgccgaagtttccaaatggatacggcagtttttcgagctgtgcctgacaaaagaggcaaacaacaaatatccgctggcgcggctgaaacagtggctgggtatgatgaagaaagaatttgcagcagcacaaaatctgttcgaccgcgtccgaacggttaaggatgcggacgaagttcggaacatcttggctgaatttgagcgagaaatgaatacttgaatatgtatagtggattaacaaaaaccggtacggcgttgcctcgccttagctcaaagagaacgattctctaaggtgctgaagcaccaagtgaatcggttccgtactatttgtactgtctgcggcttcgtcgccgtgtcctgatttttgttaatccactatatccgctccaaagcaaatgccgtctgaaaacctttcagacggcatttgttgtctttattgccgtttttcgtccgtatccggatttttgtttttcagcttcgcacccaagcccaaacgcctttcataatccgattgcggagtatcgtcttcctgcataccgaacgcgccggcattgacccacagcgacagcagcgcgacgacaaaggcgcaaaagccaatcacataccaaaacattgcccctcccgatttgttaaaatcatatcaaatacagtgccgaatttatcacaaacgcacgggcaaatatagtgaattaaatttaaatcaggacaaggcggcgagccgaagacagtacaaatagagacctttgcaaaattccccaaaatcccctaaattcccaccaagacatttaggagcaccttcttccagcaaaccgcccaagccatgattgccaaacacatcgaccgtttcccactattgaagttggaccaggtgattgattggcagccgatcgagcagtacctgaaccgtcaaaaaacccgttacctccgagaccaccgcggtcgtcccgcctgtcccctgttgtccatgttcaaagccgtcctgctcggacaatggcacagcctctccgatcccgaactcgaacacagcctcatcacccgcatcgatttcaacctgttttgccgtttcgacgaactgagcagtatagtggattaacaaaaaccagtacggcgttgcctcgccttgccgtactatttgtactgtctgcggcttcgtcgctttgtcctgatttttgttaatccactatactttatgccgctaccgcaactggctggcgcaagacgacaccctgtccgaattgctcaaactgattaactgccaactgaccgaaaaaggtttaaaaatagagaaagcatccgccgccgtcgttgacgccaccattattcagaccgccggcagcaaacagcgccaggccatagaagttgacgaagaaggacaaatcagcagccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaaggtctgcccaaaggtacgaccgtctatgccgacaaaggctatgacagtgcggaaaaccggcaacatctgaaagaacatcggctgctggacggcattatgcgcaaagcctgccgcaaccgtccgctgacggaaacgcaaaccaaacgcaaccggtatttgtcgaagacccgttatgtggttgaacaaagcttcggtacgctgcaccgtaaattccgctacgctcgggcagcctatttcggactgatttgcgcccgctgccgcctaaaaggcagcccggatgcctgattatcgggtatccggggaggattaagggggtatttgggtaaaattaggaggtatttggggagaaaacagctgaaaacctgtgtttgggtttcggctgtcgggagggaaaggaattttgcaaaggtctcagagtgagtttattttggggcggcggcaggtcgggggcaagcggcgtggggcttggttgtggtttttaggtttttgggggtaaaaaatgccgtctgaacttttcagacggcgtttgttttttctatccaatcgaggaactgccgccatttttccagcggcatatcggcccgacgggtttcggtatcgggttcggcttcccagcggcctacctgtatgtagtgcttcaccccgacgatttgcgccaactcggcctgtgtcagtttgcagcggttgcgaagggtgcggaggttgtaaggcgtgtagccgagttccatgtcgttgcggtttattttgtttcgcatatttttttgactgcccggcggcaggtttcggtaaggatggcggcaaatcgggcttcgtctgccggtttgccgtcgaaaaaaataaaatcgtaaagggtgatgccgttttcggaatggcggtaatgcctgcccgggcattcgccgtctgtctgcctgtggattttggcaatcaggcggggatagcggcaatgggtaatgaaacggcttgcgccgtcttgcccgataatccattcggggtagcggttgaatagtgcggctctgttcattttgttcgtgggataaagcccctcgcggggcttgtggtcaggcaaatttgaatatcagtgccaacacggcggcgatggcggtaaccagcccggtggccgctatcatgggataccagcgggactcttgggctatttttacggattcggcgttgattttgtgcgcgtcggcaatgattttggcgatttcggcatctatttttctcagactggagtgtttcatttcttgttcgattatgttcatcgtacttcctttcgtttttggcggttgccgccgcttgtcggatggtaggatgtctgccatgtgtatatattgataccttttaggttttattgcaagtgttttgggcggcggcttcgtatgcttggcggtggcggcggctgtaccattcggcgagttcgcgccgctcttggaggcggtagctgtcggcggtcaggtagtggtgcaggcttgagaagccggcgcgttggagggcggcgcggctgatgtggccgagggcgaggtctgttgtgagggtgtcttttccggcggtcaggctgatgttggtgaagaggtggcggaatccgtgcattgtgtgtttggatttgccgggggtgctgccgtcatagcccagtcgtcggatggcgttgtgggcgaatttgatgctgatgtggtcgggatggggggcgggtttgcgccgtgggcggatgccggggaaaaggtggatgttgtcgccggtctgtgtgtgcagctctcggagtatttctaccgcccagtccgacagtaggacggtaaaggggtgtttggtcttcatgtcggcggcggggatgtgccataaccgggcggtgaggtcgatgtcttgccagcgggcggaaagcagtgcggacggacgggatgacttccccggtttccccatcaatccgcgccgcctcgatttttccgttggcgcgcagcatttccaccgcctgccgcaccgacatcaaccgcttgccgttgcgcctcatcgcctccaccaaaaccgccgaaatcaatttggcttcttccggtttaagctccgtcttgcccgcatcgctgcgccgtttgcgcgtcggcttgacgctgaccgcctccagcttgcggtatagcgtggcaaggctgatgcccaattcctgcgcctgctgcttaagatatgcagagcgtgcgccgcgttccattgcttccgcctgattctcgactgccttaagacgctcaatcattgccggattcatcgccttctcccgtttcaccgcccaaccattccggcacattgtctgtcggtgcttcagtcggcagggcatagctttcgcgcagttgctcgcagtccaaaataatttgattgagcgtgccgaccatctttgcctgatggctgatcccgtgtgcctcactgtgcgcattaagttggtcgaacaaatctttcagacggctcacttgactgcggataccgacctcaaggcttgttaactgcatcgccaactcgctgcctacgtcttccgccttcggctctctgacaacggtttgcttcttagccagcttctcggccagctcatcaattttggctgttttggttttcatcacttcgtctttggcggcgaggttttcgcggctttcgcgcagggcgacgcgcagctcgcgcaccgtcattcggtccacatcgtcaaaggtcatgccgttgacttcttccccttcggccaaacccaccagcgtaacgtcttcttcgaccagcagctcaagcagcttcgacttgcccaaatccatcagcttcggcgcggctttctgcatttgcggggtcgcaaagcggcgagtggctgacatcagacgtgatgtttctgcgatacccagcccaaattggcttttcacaatttccataaaccgtccgtgttccgtatgctcttttaaaataatcagcgcacgtcccagttcgaacatgccttccatcgtctgccgtactgcttgacgaccgcgttcaacccaacgctcttcgctataagtctcgccgttaccccactgctccatcaccagcacactgcgcatcgctgcctgattgcttactttgtcggttgcgataatttcaatttctgtattcattttttatctccaaagtttccgacgtcggaaactttcaaaatccgttaatccacatcgacccgcttgccgatttcggcaatcttgctttgcagccgttcatgctgctgcctgaaccgctctgcgatttgcagggttttgatgccgtaggcgtagttgccgttttcaagtttgatgaccaatcccgaggcaaccaaatcatcaatatccctgctgacttgcgatggcgtcagccccagtccgaccgataaatccttattgctcagaccgataatcggatgctcgtcaagcgcgataaagaccctcaatagccgttgtacccttttactttctgccatccgcatcctccttatttcagtcccagcttcttggcaatttcgtgccccttgccgtaattgcctttgcgctgtccgccgatcaccagatacacatcgcgcggcttaaagccgttctctcttgcccactgcgccagcgtctggccgtttttggcaaaattttctttcaattcgtctgccgtaagcatttctttggcctgtacgcgggaaaatttcagtatccgtccgtacggttggttaatacactcatgattaatcatcgcttttctccttcatccccagcaaaaccgccgcttcgtggcttttgccaaaattgcctttcagcttgccgcgcaagaggtgctccaccgtggtgcgctccagattgaaatatttcgcccaatgcgccttgcacaccccgttgcgcttaaaccacccggccgcgctctcgcgcgtttgcggataggaaataggcttgaaattcaaaggtttttccatattatttatgcctttcgtgtgatataatgtgtttgtttttaggtctctttgcacgataaacatccggtctgttgtgcagcagcagggtcttggcttgttttaaagtaaacaagctttttctcgtagctgggtgtatgtgatccatcatgagctgtcgcgcatgagccttcaaagtgttcattttttcgtcctttctcgtgatgatttagggtgtttgtgtttcgatgtggaaattataggaagaattcttcctattttgcaaggaatatttatgaataactcttccttttttggcaaccgattgaaagaagaaagaaaaaaattaaaaatgactcaagctgaaatcgctgaaaaatgtggggtttcaggaagaatgtggggggattatgaacgtggcatcagccagccaaaagcggaacttttcttccaatttgaaaaggtgggtatagacgttcaatacgtcatgcacggcagacgcggcgaaacagcggtcatgccgtctgaaaccctgaacgccgaagaacaagaactgctggtcttgttccgcgaggcggcagctgccgaccgtgaaatgattctgatggttgcgcgcagggcagagaaaaaagcccaaactgcgcttggtaaagtgagtaatggataaaatggatcaattcgaattgtgccaaaaagaacatgtcaatccatttgccttgtcaaagcaatatctattggttgtaacattcgtcaaatccagcagtaaaaattttcaggcagcattactttgggcaagaagtgccaaattatttgagaatcttgagattggaaaagaaaccatctattgctgcgctttcgataaaacagcagaacaggctgggatggccggggtatttttgaattatattgaaaattggaatggcaaacagatttacatcaatggccgaatccatagtggcagtatttatgatttgttaggggttttagactgctatcaaaaatcacagtcctgtcccaaccctaaaagccactgttgctttgtttcagacgacatttttctatggcatggatcaagaccaacgtttgaaatcagtcttgatctaactggaaagaaaaaagaaacatcctctgcaaagaaatttgtgatgccttgtattaatttccgtcaccataggattgaaaaagaaacctacttaggaaattggaatgaacaaattgccgcattggcagtaaaacaaaatatagattggtgtccaagttttgatattgagaattttagacagtatgaataattactatctatataggaattgcagcagcgatgtgttatgggtcaaacgtatccaacgccaaatcgacggcagcctactcttgatttctgacaattcaacctatccacccatgcccttggcactggcggaacaccccgatattcaaatcatcgggcaggtagtgcaggtatcaaaagacttgaactagacacaatcaaaaagggaaatagaatgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaaatctattaagtagaaaaaatagaaagggaaatgatgattgagaaaagtatttctattgtagatggaaaggaatactccgtttttgctgtatcacacgagtttcgttatacctttgatgagcctattttagtcgctgacttgattagttctctaaaagcttatgaaacactgacaagtagttatcttccagcaattttgaatcagctgtttgatgtcaaaatccaaaaaatcaaagtagctgtatctgaaattgaaagaggatctttccttgaaaaactgattttcaatttattcttcaaagatgaagatgcttataatgaattttgtcttaaaatacgaaaatttctaggaacagaaaatcaggacggaagtattaatatgtccaaaatcattatgtttgcaatgactacacttttaggggtaggtgctggttatctcttgtttaaaaacccgccacaagagaagcaggcaataaccaacaacatcgttaccgtcattaatgctgatagttctgtcgcactggatggtgaacatttggtttcagtggtaaaagaagtaacaggaagcagcaagcaaaaaactgcagaaaatgtggcaaaagtatatgctccagcaagtaaaaataatggcagtattacccttgggacagatgatgttcggattgaacctgttgcacaacaaactgtagcaactttgcctaaagatgtggacttacgtgatacgccattgactgaagattacaccgatattgatgtgcaaattcgtgctactgaccgtgataaaaattcagggtggtatgcagtcatagaccaaattgttccatcacgtgttcgattagaactgcctgaagatattgatttgaataggctggctaacaatgctactatccgtgcaaatgtaacagttgagtttgacttaaagcaaaatggctctcgtaagcctaaaaaaatcatcctcacatctctctctactgattaagttttaacccgtattaaaggcttagtcagacggcctttcctacaatccctgtattgatttttaattcaatacagggatttttccatgtcagacaagttcaaccaattcatcaaccgcgtcctctctcacgagggtggttacgccaaccatcccaaagaccccggcggcgaaaccaattggggcatcactaagcgcaccgcacaggcaaacggctacaacggctccatgcgtgccatgacgcgtgaacaggcaatcagcatttaccgtaaagcgttttgggagcgttaccgcgccgaccaaatgccggaagcggtcgcgttccaattttttgatgcctgcgtcaaccacggttacggcaatgccgcccgtatgctgcaacgcgccgcaggcgtaccggacgacggcgttatcggagcagtcagcctcaaagccatcaattcccttcccgaaaacgaccttttattgcggttcaacgccgagcgtctggtcttttataccaagctcggtacgttcacctctttcggcaagggctgggtacgccgtgtggcgcaaaacctgattcacgcgtctgcagataacactgattaaagggagataaaccatgtcaaaaaagtcactcatcgccctaatgaccgcagccatgcagcccgatttcagccacagcgacctaggcattcgctacgccatgccgactcagggatgttggacgcaagcccaccgcaagagcggggtagccgccgcgaaacgcgcagccaaaaaaaagcgtcacaaataaccgcctttttccgatggctgggcggcttggtctctaatccggccacaggaaaaatcagccataccaaactatgggcaaacgtcgccgcagccgccatgacttggaagttcgtgcaggcggcggacgcgcccgaatggctctagtgggcttatggcgcattggtcggcgggtatgcattaatcaaacgcggcatcgcggcgattccgcagttggcagaaatcaaaaaatccgcaaatcaggaaggggggcggcaatgattgaatttgtccgagccaaaaaacggctgctttgggcatttgtgcttttgcttgtgtggacgtgcggttaccgatacgccgccgacaaggccgaagcgaaacaaaccgccctgattgccacctatcggcattcttctatggttgcggcggaacaatatgccttgcagcttaaaaaagcgcaggacgaaaggcagcggtggtacgacttttcccaaaaacaaggaagaaagcccgtgaaaaaacagtatccgccgcaaacgaaaaaagccggctatctgaaaaccaaggaagaactgcttgcggaattggcttgccttaaagcggaaatggttgccctaaaaaagcccgatgccttaatccatgggaaagaagtgcggcagaaagaacgcaactcgtcgcagggttaaggcaatgccatccgttgaactgctgttggagattgtccttctattaccaattggccgtccaatcggcagaagacaaatatgccgatttgaaacggcatatccatgatatttatcgacgacataagggaagatacggctaccggaggattgcggcagccatccgtcacgcaggaacaccggtcaatcacaagaaagtcagccgtctgatggcgaagacggggctgaaggcagtgatacggcggcgcaaataccgctcgttcaaaggagaagtcggcaaaattgcgccgaatatcctgcgacgctgtttccatgcagaaaagccgaatgagaaatgggtaacggacgttaccgagttcaatgtaggcggagaaaagatatacctttctccgattatggatttgtttaacggggaaatcgtcagttaccgtattcaaatccgcccgactttcgatttggccggcgagatactgaaaggtgcgccggagaaaccgggatcgtctgaaaagccgatactgcattcggatcaaggttggcaatatcagatgttttttatcaaaagcagttgaaaggcaacggtctggttcagagtatgtcccgcaagggaaactgcttggacaatgcggcaatggaaagtttcttcggaacgttgaaatcggaatgtttccatacgtgcaaatatgattccgttaccgaatcgtaagcggcactgcacgaatatatccgttactacaacaacgatagaatcaagttgaaattaaaaggactgagccctgttcagtacagaactcagtccctgaaagccgcttgattaaactgtccgactttttggggtcagttcggcttcggcatttttttatccgttttgggggtaacttgtttggaaagctgcaagcttataaataaaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatgctgctgaaaatagggtatggtggaggcggggggaatcgaacccccgtccgaaagtcctctacaaagcgttctacatacttagttgtgtctatttgaaaatcttatttccatcatgccgaccaacaggccttttggaaaccagttaccttaagtcttatttcctgccaagtaacccggtaggaaaccagtcaatgtaagatgacgttgcggtggctttcgccacacagcccattgaccgactgctgcaacggctagccttaagcggctaaagcgtaagtttcgtcgtttgcgactatttgaattcagtgttttacgggaatctgagaccccggtatgcccgcatctgcttcgcaaccctcgtcgaaaccaaggtcgcccccagaaatggtttgcaaattatacggatattgtgcggtgctgccaagtctgtcggagaaatttgtcagtcttgctgccttaatttgcgtttgagcaggatgcggacgcagccgtcgttgccttcccggggttcggcgtaggcgagtacgtcggggtgttgcatcagccagtttcgggtcatatttttcagaacgggtttgtagcctttggaacctaatccgctgccgtggatgatttcgccgcatacgccgcgtttttgggtgaatgcgatgaattcgttgaggactttttgggcttcttcctgtgtgtagccgtgcaggtcgacatcggtaacgacgggatagtatccgtttttcaggcgttggatgtcgttttttccctgtccgtttttgctgaagctggcgggcgggtcgttgtatgtgctgccgatgtagaagtagttttcttcgtcggcgcggttgtctttgggacggactttgatgggggttttgtcgggcggcgcataatattgctgccggttttttaatggggagagttgtccgactgcttgtgaaaaatcgaaatcctgttcttgtttttgcttgtttttttcggctgcctgtttttctgccgcttctttttgggcttgtttgcccagttgtttgaggatgttttggaagtcggtattcatattttttcctgttatttgtccgatggctgtttcgggcggggttttaatttgccggaatgtttgccaatcgggggaggatgattttgttgcctgcgtatgttttttgaaagtgtgattgtatatcaaaaagaaatgcggcaaccgtcggcagtgttgattgccggaaatgcggaccggtcgaaccgatatgcccgaacgcctgataaagttttaaaaacctgccttgcgaagcaggctgacgtgttttgccaatcttgaattgccggaaacgcgaaacacggaaatctgatgttttatagtggattaacaaaaatcaggacaaggcgacgaagccgcagacagtacagatagtacggaaccgattcacttggtgcttcagcaccttagagaatcgttctctttgagctaaggcgagaacgctgtactggtttttgttaatccactataaatgttccgatacgaactgcaaaatattggttttgtttctgacaggcaaaagcactgtttatttggctgtcaaaaggatggttaaggaaagttatgcgcccctgaagcgggccccagataaggatggttgcgccgacggcttcagacggcattttggcggcggtgttgggttttgtatccggtttgccgttgtgttttgtgatgatgattttgggcgcggtttttctgttttgatgtgtgaaatgccgtctgaaaggcggttcagacggcatagcggtcatttttgtgcggtcaggcggtcgaatatgccgccgtcggcgaagtaggttttcatgatgttgtcccatccgccgaattttttttcgggagagaaggtgtctaagtctgggaagtcggctttgtgtcttgccaatacttcggggttgcgggggcgcaggtagagtgaggcggcgagttcttgcgccggttcgctccaaaggtattcgagataggcgcgggcggttttttgcgtgccttttttcgcgacgacgctgttgacgacggcgacggggctttcggcggaaatggtgtagctcggatagacgatttcaaactgtccttgggtcagttttttgctgacgtagttggcttcgttttcaaaagtgatgagtacgtcgccgatgttgcgttgtgtgaaggtggtggtggcggcgcgtccgccgttttcaaaaacgggggtgtttttgaggatggatgcgacgagtttttgggcttcctgttcgttgccgttggtggttttcagaccgtaaccgtatgcgccgaggaaggcgtagcgtccgttgcccgaggttttgggattggcgatgacgatgttaacgccgtctttggcaaggtcgttccaatcgcggatctgtttggggttgttttttcggacaaggaaaaccatagtgctggtgtagggcgcggcgtggtcggggagggcttgttgccagcctttttctaccagtccttttttttcgagcaggtcgatgtcggaggattggttcatggttacgacatcggcttgaaggccgttggctacggataatgcctgtttgctggagccgccgtgggactgttggatgctgacggatgtgccggggtgttcggattggtatgttttgataaataaggggttgtattctttgtaaaaatcccgtgccacatcgtatgaggcgttgagcagggtaatgttttttccgtcggattcggtattggccggggcattttgtccggacggatggtttgaatcggctgcggggctgcaggcggtgagcagggctgcggtatagagtgccggtgcgtaggttttcatatgcttgtcctgtcggttggtagatggggcaactttatacggctgtctgcgcttgtggaaataatgtttgatttgaagattatcagttttggttataaggacggatcagaggtgtttccgcatcagttcgcatttgattttgatgctggggtcaagctgcaatactgccgaaccgagcgattcgtagcggttgagaaggtaaaacgggacggagttgagcgatgcgtagagtttcagaaagctcaaaccggatttgtgggcgatggtttccgcctgatgaagtagggcagtgcccagtccgaggttgtggaacagggggtggacgtaaagtgcatcgagttgtgcttcttggcagtcgatttggaaaaatccctgtatgttgcctttgtattcggcaacccaaagtgctttgtcgggatcggaaatggtcggcaggtagctttctgtgtttagcaagccttcccatacttttagggcgtgttcgttgtagctgaggatgcaggtgtattggacggagtgcaggtggactttgaagatgtctttgcagtcttgcacggtggcggggcgtaacagtgtcagcaggctcatggcggtatgtcggcggcttcagacggcatctgtgccgttggtcggattatagggactgatgcagtttttttgcttcttgaaatgcggtgtccgaatcggtggttaaaacggtaaagtgtcccattttccgccctttgtgcgcggtttttttgccgtaaaggtgcaggtgtgcattcggatggctttgcaagggcagccaatccggttcgccgccgtcttcctgccaaacgtcgcccaaaatatttgccatacagcaagaactcagtaatttggtatcggcaggcggcaggttgcacataatgcgtacctgctgctggaactggtctgctgcgcaggcatctatcgtatggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaattgtccgccgccgaggatgccaagcatggcgggcggagaaagagatatgtttttcatgctgactcttcaaattgtacaagttgatagctataactaattcttgacggatgtcttgtatcgctggaattaccagtttcagaaatacagaatactttttccataaatttttctgcttttagaaattccagtattctgtttttttcatccttataagcaccgcggtctgtaccccatgcaagaataatcatatcagcatcttccaaacatcctttaaatttggaaaaatcggtttgggtgtttgccctaattcctgtttgctgtgtagagtaactggaaaaaatatttaacattttgaagttggtaaaaccgtacatatccaagaaacgtgcaagttgggtaagggttttgtcgcttctttcatcatttgctttacttggattaattcctatagcgacagctgagaaatttttaggattttctgtgttgccgctccatctaaccgttaggatttctcgatttttttcattatctgtatagagaccgtctttggtagtcggtctgagtgtttggcgaagctcataaagtttttcataagtcatttatccaacccttcctgtaccatttgcgcggcgtgtatgacggctcgggctttgttttgtgtttcctgccattcggaggccggatcggagtcggcaaccacgcccgcgccgctttggacgtatagcgtgttgttttttactacggcggtgcggatggcgattgccaaatccatgtcgttgttgaaaccccatacgccgacggcaccgccgtagatgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtagtaaaagagataaggcgaagggttgagcgtacgcagggcgcggtagagggcgagcgggctgtcggtgaattccatgctcatgcgctggctggggacaacctgcatgcagtcgcctgcgaagatgtagtctttgattttgttaacgcaggctttgaacggctcttcgccgaattcgctgacggcttcggtgtgtttgctgccgagcgagagcgggatggcgcagctttggcgcaactgggtgcggatgtcttcgaggcgttcgcgggcgcgttcgtagccgtcgggctgcgacggatcggcgtaaacgacgagatggattttgccgctcaaattgtcgatcaccgccaattcttgcgacagcatcagcaagatgtcgggcgtgccgagcgggtcggctttggtggtgtttttcaggcggtgggcgaagtgttcaaaattgtagatggtttcgtaaccgaagtagccgaccagtccgccggtaaagcgcggcaggcttgggatttcgggtgttttgaagcggttgtggaaggcttcgataaagggcagggggttgccgtcgtgttgctcgacaatttcgccgttttgataaacatcgacgtgtttgccgctggctttgagatagtggctgcaaggcaggccgataaaagaatagcggccgaaacgttcgccaccgacaacggattcgagcaggtaggtataggggcggttggcgagtttgagatagagggaaagcggcgtatccaaatcggcaaggagttcttgcacgagcgggatgcggttgtagccttgggcggcttgggcttggtattcttgtttgctgatcatttctgctttcccaaagggcggtttcggacggcgcggcaacgggcgcgagtatagcattttatcggaattgttgacagtctgaccggagatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacgccaaacgggcttcagacggcatttttgacggcggaggtctatgagccgcaggttttcggcttgttcgccagaatattgatgactttgcgttcggctttttgcggctcgattttgatttcgctctcgtcttcttcgctgccgtctgaaaaacgttcgggcattttttcgctgtcaaacgccaaatcgccgccgtgtttcaggctttgaccgcgttccaatccgacaaagtcgaagagttcggtatcggcaaggtgggaagggacgacgttttgcagggcggagaacatcgattcgatgcggccggggaagcgtttgtcccaatcgcgcagcatatcgccgatgacttggcgttgcaggttgggttgcgagccgcagaggttgcacgggatgatggggaattgttttaattcggcgtatttgattaagtctttttctttcacatacgccagcgggcggatgacgatgtgttcgccgttgtcgctcaccagcttgggcggcatggctttgagtttgccgccgtaaaacatatttaaaaacaaggtggcgaggatgtcgtcgcggtggtgtcccaaggcgattttggtgcagcccaattcttttgcagtgcggtagaggatgccgcggcgcaggcggctgcacagcgaacaagtcgttttgccttcgtctaatacgcgtttgacggtggagtaggtgtcttcttcaacgattttgtagggaacgccgatgctttcgagataggtcggcaatacttcttcggggaagcccggctgcttttggtcgagattgacggcaaccagttggaaatcaatcggcgcgctggcttggagctggcgcaggatgtctaacagggcatagctgtctttgccgccggagaggcagaccatgattttgtcgtccggctcgatcatattgaaatcgttaatcgcgtcgccgacggcgtggcgcaggcgtttgctgagtttgttgttttcgagttcttgtttggtttttttggacatggcggtttgggtttgaaaattagaaaggcggcattgtaaccgattggcggggcggcaatgccgtctgaagggcttcagacggcatcggcggcttattctgcattttcggttttaaagaagagatgaaccgctttgaagataccgccgtttgggacggtcagtgttttttgtgcggcggagaatttaatcacggtaagggcggtaaagttttccgaatcttgaacgctgtcgagtacgatgccggcctcttcgccgtccgccgtcagcagggttcctgcttcgacggccgaatttcccgacaataccgccaagccgcgtttgacctgcccccgatactgggcacgggcaatgatttcctgtcccggatagcagccttttttgaagtgtacgccgccgatgatgtgctggttgagcatttgggcgacggcggtttctttggtagccgcgcatatccacggataaccgctacggatttcgtgcagccgccacgcgttttcggcggcggcatcataaggcggcaaggcgtttttgggggcgatgtgcaaaatgccccgatgtggcaggacgacggaacagatgccgtctgaaccgcattcggcggtaaaggcgaggctgggttcttgcgcggcaagcggttcggcggatgcttctaattccgcgccgacggcgtaatcttcaaggatttcaaaaacggctttggcgcgtaacacaaacatccgcaaacgtttgaccgttgcttcaagcaggtcttgcgccataatcagcagcaaatcgccgcctcggttgacgacaatcatattggcgatgacgcggcctttgggcgtgttgtaagtcgcataacacgcctgcccggtctgaaggtggttgatgtcgttggaaagctgtccgtgcaggaaggtttggcggtcttcgccgctgacgcgcaccacgccgaaaaagggcagtaaggttttcatcatttgcgtactctgaaatataaaggaaatctgtttatgcagttgccgcgtctctcttcacggcggttattttgatttcgacgcgccactccggacgggcgagccgtgcttccacgcaggcgcgggcgggcgttctgccggcggcaacccaagcgtcccacacgccgttcatttccgcatagtcgcccatatcgcgcagatagatgaccgcatccaaaacgtgcgctttgtccgagccgcattccgccagccagcggtcgatttgggcaagcacgtcggcagtctgttcggcagccgtttcaccgttttcgggaaccatgccggagaggaaaatcaagccgtttgcgccgacggcttcggaatagcggggcgttgtgccgaaatatcggatatccatatcggtttccttcgataaaggggatatatggtaacattgcgcttgaccgatttccatgttttgcatgacgaaaaatgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttgacgggaaagtataaaggaacaatatggacaaagatttgtatgccgtattgggcgtgtcgccgcaggcgggagcggacgaaatcaaacgcgcctaccgcaagctggcgatgaaatatcatcccgaccgcaatccgggcaatccgaaggcggaagaaaagttcaaagaaatccaacgggcttacgatacgctttccgacctgtcgaaacggatgcaatacgacgcgtccttcagacggcatgaggaacgcgggcggcaggaagaggcattccgccgcgaacaggcgcgcagggagcagttttaccgcgaacagatgcgccgcgaacaggcgttcagacaggcgtttgaacggcaggcatcacgttcgtgccatacttacgaaccgtccggcggcggaagcgggcgcaactatgtcctcgccgcctacatcctgttcggtttgggtgcaatcatgctgttcatgcccatagtcggcgtgattttcgcctatatgcccatagtcggcgtgattctcgcctatatgaaacggaacagtttggacagcattgtctatgccgcacataccgaatacctgattaaaaccttttggcgcacattttggctttatattttgggtgcgctgactgcccttttgggtatcggcgtgctgattattattgcaacgaacgtctggtatttctaccgcatcatcgccggctttatccgcttcaacggcggcagggcggttgcacccgagaaatggatatagtatggcttacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgctggtattgaagccggatatcggcaatatcggcgcatttttgccgacgtggccgctgtttgccgctttgggcgtgctgctgccgtccgtattcgtgataatgggcaaatctgtggaagccgccggtatcgtcaaatccgacgcggcgcagcgtttgtcgctgtttttgccgattgttgccgccttgacgctgtttggcgaaaaactcagcgaaggcaaactaatcgggctgtgcctcgcatttgccgcactgttctgcctgctttggaaacacagcggtggcaaaaaatcaggaagcgcgtggcggcaggcggcattgctgctgggcgtgtgggcaggttacggcattatcgatatcctgttcaaacagcttgccaaaagcggaacggcatttgcgggcaacctgctggttgcatttgtgctggcgggtgtgctgatgtttgcctgcctgtttgccaaatcggtcagatggcgtgttgagagtgtggtcggcggcatattcttgggcggtttgaattttatgaatatcgtaacctacatcaccgcgcaccaaatgatgaaggataatccgaccttggtttttgccggtatgaatatcggcgtgattgttttgggtacgctttcgggcgcattgttctttaaggaaaaaatcaacacaatcaatacggcgggaatcgtgttggcactgtgttctatcgcctgcctgttttattggggggaagtcaaggtactgttcggcatataatccggctgattgatataacaaaatgccgtctgaagcagcatccctgcttcagacggcatttgtctgcaacgttacagatgggggttcatcaggttctcgggagagaggatgcggttgagttcttcttcgctcaacagcccgcgttccaagacaacctcgcgcacgcctttgccggtttgggcgcagattttgccgaccaaatcgccgttgtggtgtccgatatacggattcagataagtcaccaaaccgatggagttgaaaacgtaacgttcgcagatttcgcggttgaccgtaatgcctttgacgcatttgtcggacaggttgactgcggcattgcccaagagggaaatggtttcaaacatacattgggcgatgaccggctccatcacgtttaattgcagttgcccggcttcggcggcgaaggtaatcgtcgtgtcgttgccgatgactttgaagcagacttggttgaccacttcgggaatcacgggattgactttggcgggcattatggaagaaccggcctgcaattcgggcaggttgatttctttcaagccggcacgcgggccggaagagagcaggcgcaagtcgttgcagattttggagagtttgaccgccgtgcgcttcaatgcgccgtgtaccatcacatatgcgccgcagtcggaggtcgcctcaatcaggttttcggtcagtttgcaaggcaagccgctgacttcggagagttttttgaccaccagttcggcgtagcctttgggcgtgttcacgcccgtgccgattgccgttgcgcccaaattgacttccaacagcagttggcgggtgcggtcgaggttgaggatttcttcttccaacaacacttggaaagattggaattcttggccggcagtcatcggcacggcatcttgaagctgggtgcggcccattttcaaaacgtctttaaattcttcggctttggcggcaaaggcgtttttcaggacagtcagtttgtcgagcaattcgccgatgctgtaatacacggcaaggcggaagcccgtgggataggcatcgttggtcgattggctggcattgacgtgatccatcggattgacgatgtcgtagcggcctttttcgtatcccaagacttccaatgcgaggttggcgatgacttcgttggtgttcatattgaccgaagtacccgcaccgccctgatacacgtcggacgggaattggtcgaggcagcggttgttcagcagaacttcgtcgcaggctttttcaatggcggcggcgatttcgggcttgaccgcgcccaactcaccgtttgcctgtgccgtcgcctttttcaccatcaccatactgcggacaaactgcggcacgtcagaaattttttgtgtggagattttaaagttttcaatggcgcgcagggtgtggatgccccaatacacttcggcgggaatctcgcggtcgcccaataaatcgtgttcgatacggacagtcatgtttttacctttgtaagtcggataattaatattgaaaaaatgcgccatcggaaagatgccgccgcaggatgaacactataccggccggatgaaattgtccatatcgtatgccgtctgaaaacgggaaacgttgttttcgggtgttatagtggattaacaaaaatcaggacaaggcgacgaagccgcagacagtacaaatagtacggaaccgattcacttggtgcttcagcaccttagagaatcgttctctttgagctaaggcgagccaacgccgtactggtttttgttaatccactatactttccggactttccggcaagccctgcctgccgctgaaatatctttcggcggattgtgctccgccatatcggcttaccgttggcggggcggtttgatgaagacggcacaaatgccgtttgaaggacgttcagacggcatttgtgctgattcgcatcaagatttattgtttggctgcctcgatttggatgtcgatgcggacgcttttggtcataccaacgttaacgaggtagtccatgccccatttggtgcggtcgatggtggtgctgaagtcgccgccacaaacttcggttttctccatcgggctttggtagcagttgaatttttcggctttgagtttgacgggggcggttttgccgtgcatggtcaggttgccgtcaacggaaaccagttttttgccgttgaagttgaatttggtggaaacaaagcggatgtccggatattgggcggcatcgaagatgtcggctgatttcaggtggtcggtaaagtgttgcgaaccgctttgcaggttggcaatggggatggtgatgtcgattttaccgtcgcgttttgcttggtcgaactcgacggaaccggtcagaccgtaaaaaccgccgacgttggtgctggtgttgaaatggtcgatggcgaaacgggcgttggcgtgatattcgtccactttgtaggtggcggcggaggcagtactgatggcggcggctgcgagtgcggcgaagatgatttttttcatgatgataatcctttgtgtgggccggtaaaggcgtttatcctaacataggcagggatttatggcatttcctgccggtaaacggtgggtttgcaggcggttgacgaacggggcgggcggaaaagggcggatgaaaaagcgcggtgtgatccgcgctttgtttttttacaaggcggcgagtaccgcatcgcccatttcggagcaggaaacgagttttgtgccttcttcgtaaatgtcgctggtacgcaagccttgttgcagcactttttggacggcgttttcaacttgttgcgcgcgcgcttcgtcgttcaggctgtaacgcagcaacattgcgagcgagaggatggtggccagcgggttggctttgttttgtccggcgatgtcgggggcggagccgtgagacggttcgtacaggcctttgccgttttcgtccagcgaggcggaaggcagcataccgatggagccggtcagcatggaggcttcgtcggagagaatgtcgccgaagatgttgccggtggcaatgacgtcgaattgtttgggcgcacgcacgagctgcatggcggcgttgtcgacgtacatatgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggcttcagcgtggaggcgttggctaattcgggatataaaacagcaggacgcaaattggcaaacaggttcaaatccttacggattgccaacaggccgcgctcagggcgcaacggacggtcgaggttgtcgtattgaggagaaccgactgcaccaagcaggacggcatcggctttgcggcagaggttttgcgtaaattcgggataaggatgaccgtattcgtcataggcttcgccgcccaatggggcgtattcgtagccggcatccaaaccttgggcgatgagtttgtcgagtacgcggacggtttcggcgacgatttcgggaccgatgccgtcacctcggaggatggcgatatgtttggtcatttcaagtttccttatgggttgatggttgaagggttatttctttttgtatttgtgtgcaatttcgtgccaacgaggtatggaaatcgatcggttgtagtgttttttataggcttcctcaaatttctttttccataaggatgcgttatgccgtgttgccgggttttgataaacggtttcttcaattgcggaaacaaaatcttccaagcattcaaacataggcatattctttttatttatgctgtaccaaacacccgggcggattttatgcaccacgccttttttgacttgaagattaattgcccacccatccatgcttctcgtaatttgccatacttttttaagccataaatccttgatggttacattgccgttgtcgtccatatcgtaaccgaatattaaatagtctacatccagcatatagggtttatgaatgatttcatcagaatacattttaaaatctgcaatatcaaaacccggactggcatttcggttgaacgcctttacttccaacaattctctactgcggtcttttttatttaaaaagaaatcggggggcatttgggtattggttgaaacatcaaattcaatttccctttttctcaaccatccgccgagccattcctgaatgatgttgccgacgacatctttttgtttgacgataatatccacatcgcccaagaaaaatctaatttgaccattgaccgataagattttttcctcattcagcaacttatcaaatatttgttgtgcagtaagttttaccattttatccctatcggtttataaagtatgcagaagcctttcagataccgccttaatcacaggaacggcaacggtattgcccaataaatcgtatttgtcttttttaggaatatcaaacgaataatcgtccggatagccgaataagcgtaaaccttcttttccggtaagtgtgcgcaaaccgccgttgtcaacgacgaaaaggtgctccatatccattgcaactaaggttggcgcaacatcatttgggtctaatattttattgatttcaaatgatttttttcctgaaacaatattgtagcctttgggcagggattcatctttgattcttcgcccgccaattttttgtttcggatgctccaaaaccaaatagcctttatctgtcaggctgtccaaaatattttgaagattggggtgtttatagaaagttgaaatttgcgcttttgtcaaaggcatcccatccatccaatcgatgccgatttctgaagcccattttttcttcctccgttcttttagaagcatatttaataattgcttctcttcttcggttactgtgccttttaattcaatatcccaactgtggatattgtttttccctccccgtttgtcctttactgattttccgtacagttcggacgggggaaatttctttagcaattttttgatgaaaggactgctttcggtaggcagtcccgattccaaaatattttttaatttcggacttagggttgtttcaaaagataagtcgggtttggatttcaaactgcctgtcagataaatacgcttcctgttttggggaatgccgaaatcttttgcatttaaaactttccaagaaacatagtagcccaatgtttccaaggtttccaaaataacggtcagggtgcgtcctattttttgtgtcggatcttttctatcgtgcgtcaccaatccttccacattttccaaaataaaaccttttggtttttttgcctttaaaatccttgccacatcaaagaaaagcgttccccgcgtatcttcaaagcccaatctttttccggcgaaagaaaaagcctggcaagggaagcctgccaacaagatgtcaaaatcgggaatatctcccgtttcaattttcgttatatctccatacggcacttcatcagggtagttttgcttcaatacttccaaagctgccggtttgatttctgaggtaaaaacacattcgcaagcaaccgactgtttccgacaggcttgttcaaatcctttcctgataccgctcatcccggaaaataagtcaataaatttaatttgttgcatattaaaaatctaaaaatttatttgaaatggagagttgcattattgcattaatttagagtgtcgctaagcccgcttaaaagatgaaagcaatttatcgcccctctgtttacattagccgcaacaattatatgttatcaggaatgccgtctgaacggccttcagacggtataggttttaaccgttaaacagccaaggctggctttggcggcgtttttcttcaaaggcgtgaatttcgtcggcgtgttgcagggtcagaccgatttcgtccaagccgtttaagaggcagtgtttgcggtgttcggtaatgtcaaatgtgaacgtttcgccgcttggtgtggtcagggtttgttcggcaaggtcgatggagagctgatagccttcgttggcttcaacttctttgaaaagtcggtcaacccgttcttcggtcaacacgataggtaaaaggccgtttttgtagcagttgttaaagaagatgtcggcgaagctgggggcgatgacggcgcggaagccgtagtcgtccaatgcccaaggggcgtgttcgcgtgaagagccgcaaccgaagtttttacgcgtcaacaggatttgcgcgccttggtaacgcggctggttcagcgagaaatcagggttcaacgggcgtttgctgttgtccatgcctggttcgccgtggtcgaggtaacgccattcgtcaaaggcattggggccgaagccgctgcgtttgatggattttaaaaattgtttggggatgatggcgtcggtatcgacgttgctgcggtcgagcggggcgacgatggcggtaattttggtaaaggctttcatgggtttgcgtcttgtgctgacgatgccgtctgaagcggtttcagacggcatcgcgaatcggttattcggtggcgttttcgatttttccgccgagatgggaaatgccgcgtccgacggcattgccgccttttttgacggcttctttggttttgtcccagcctttttcgacggcgttgcctgtttgttcggcggcgcgttcggcggcggcctgtgttttgtcaaggttgcgggcggtgtcttgtttcgcgccctcccaagtgccggcgcaggcggacaaggcgagggcggacagggcggtaatgaaaagtttgttcatggttaaactccttggtttgaatattaaaggtgtttctgccttacgggacatatttcagacggccgcgtcaaattcttaaagaccgcctgaaaatacttacgccatcatgcggatgtcggtaaagcggccggtaacggcggcggctgctgccatagcggggctgacgaggtgggtacgtccgccgttgccttgacggccttcaaagttacggttggaggtggaggcgcagcgttgccccggggtcaggcggtcggcgttcatggcgagacacatcgaacagcccggttcgcgccattcaaaaccggcttcgatgaaaattttgtccaagccttctttttcggcttgttctttaaccaaaccggagccggggacgattaacacgcgctgtacgttggcggcttttttgcggtctttggcgatggcggcggcttcgcgcaagtcttcgatgcggctgttggtgcaagagccgatgaatacgatgtcgacggggatttcgtttaatggcgtaccggcttccaagcccatgtattcaagggcgcgttccataccgctgcgtttgaccggatcggtttcttcggcaggattcggcactttgctgctgatgtctaaaaccatttcaggcgaggtaccccaagtgacttgcggttcgatgtcttcggcgttgaaacggtattctttgtcgaataccgcaccttcgtcagacaccagcgtacgccagtactcgacggctttgtcccacgcttcgccttcgggtgcgaagggtttatcttttacgtagtcgatggtggtttggtcgacggcaaccatgcctgagcgcgcgcctgcctcaatcgccatattgcataaagtcatgcggctttccatagaaaggctgcggatggcttcgccgccaaactcgatggcgtagcctgtaccgcctgccgtgccgatttgcccgatgatgtagagcgccacgtctttggcggtaacgcccgcttttaatttgccgtcaacggaaatcagcatggatttggattttttcgcggtaatacattgggtcgccatggtgtgctcgacttcggaagtgccgatgccgtgcgccagtgcgccgaatgcgccgtgggtggaagtgtgcgagtcgccgcagacgacggtcataccgggcagggtcgcgccttgttcggggcccataacgtgtacgatgccctgacctttgtccataaacggaaaataggcgagtgcgccaaactctttaatgtttttgtccaaagtatcgacttgcagcttggaaatcgggtcttggatgcctttgtcccaatcgccggtcggggtgttgtggtcggcggtggagacgacgctgtcgatgcgccacagcttgcgccccgccattttcaagccttcaaatgcctgagggctggtaacttcgtgcaccaaatggcggtcgatgtagagcaggacggtgccgtcttcttcttcgcggacgacgtggctgttccaaagtttgtcgtagagggtttgtgctgtcatgatgttgttcttttggataaatggtaatgcggattgggcggattttagacgtattctttataccgcgcaacagattttgtctaatttttgagtcggtgttattttgtaaacaattttaacaaaaaaattagacatattgtccatttcagtaagcagttatatctaaagcatgattcgatacgaaagaatacttgtcgtcattctttcaaaggcattatcatctgcatcttgtcaaaaaacacacagaggtagacgaaagatgaaattaccggtgatgtcgcccgaacattcggcgcaacttcaggcgtttgaggcaaaaatcctgtccaatcacgccaaaatcgaggcgtggttccgcacgcagtggagcgtacaccgcccgccgttttacggttcggtcgatatacgcaatgccggttacaaaatttcgtctatcgatatgaatttgttccccggcggcttcaataatctgaatcccaactttatcccgctggcggcggttgccgcgcaagatgcggtgcaacgcgcctgcgaaacggcgaaatccgtattgattattcctgaaaaccacacgcgcaatacgttttacctgcaaaacgtttacgccctcggcgagattttgcgttcggcagggtatgaagtgcgcttgggcagcctgaatccggaagtaaccgaaccgaccgaatttgaaaccgcattgggcgacaaaatcctgttggaacctttattgcgtacccgcgatcgcgtccatcttgcagacggcttttcgccttgcgtggttttgttgaacaacgatttgtccgccggcattcccgacatcctcaaaggcatcagccaaaccgttttgccgccgttgcacggcggttggacgacgcgccgcaaaacaaatcatttcggcgcgtacaaccaagttaccgccgaatttgccaagttaatcggcatcgacgaatggcaaattaacccttattttgaaaaaatcggcggtttggacttccaagggcgtgaaggcgaagacgcgttggcggaagcggtagaacgtgtgctggcgaaaattcaagccaaatacgacgaatcgggcattaccgacaaacctttcgtcatcgtcaaagccgatgccggcacttacggcatgggcgtgatgagcgtcaaatccgccgacgaagtgcgcggattgaaccgtaaaaaccgcaataaaatggcgaaagtcaaagaaggcttggaagtcagcgaagtgattgtccaagaagggatttatacttatgaaaccttaaacggcgcggtgtgcgaacccgtcgtgtatatgatggaccgcttcgtcatcggcggctttttccgcgtacacgaagggcgcggtgcggacgaaaacctaaacgccggcggtatggtgtttgttccgctgtctaacagcattcctaccggtaacggcgataattcccaagaagcgcccgaagcctgcaagcgcgtattcgaacaatgggactcgctgggtatgccgcgctctgaaaaagactgcgacgtggacaacgaacacaaccgcctctacgtttacggcgtaatggcacgcctgtcgcttctggcggcttcaatcgagttggaagaaacggcgtaagactgttttgaaatacagatgccgtctgaagcggaaatccggttcagacggcatttcggatatttggcgtgtgggaacatctgtttcagacggcatctcagactatttaaaaaagggaaaacatgagcatcaagcaatggccggaaggcgaaagacccagggaaaagctgttggaacgcggggcggcggcgttgagtgatgccgaacttttggcaatcctgctgcgcgtcggcacgcgcggaatgagtgcggtcgatttggcgcgttatttgctgcaggagttcggcagtttggggaggctgatgagcgcggaggtcggcaaactgtcggcatacaaagggatggggacggcaagtttcacacagtttgccgtggtcagggaaatcgggcggcggatattggcggaagaattgcaggagagcatcgtcctgtccgatccggatacggtggccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattattgcgcacaaccatccgggcggctcgcccgaaccttcgcaggaagacatcatgttcacaaggcggctggcacaggcaatgtcgctggtcgatgtgtcgctgctcgaccattttatcgttacctcgcaaagcgtctgttcgttcagacagctcgggttgatgccctgacactctgttttacatgcggcggctctgataaaatagccgcttcaaccgtattcaacagatattgttaagttaatggaaacacaaaacaaacctaccgttaccgacattgaccgccctatactcgtcccgcccggtggacataaaaaagtcttgctgcattcctgctgcgccccgtgcagcggcgaagtgatggaagccatgctggccagcggcatcgactacaccatttatttttacaatcccaatatccatccgcacaaagagtatatgctccgaaaagaggaaaacgtgcgctttgcggaaaagttcggcattcctttcatcgataaagacgacgactacgaaaacgaccgcaaagaatggtttgccaaagccaaaggcatggagtttgagccggaacgcggcatccgctgcaccatgtgtttcgatatgcgttttgaaaaggcggcgcaatacgcgcatgaacacgggttccccgtctttaccagttcgctgggcatttcacgctggaaaaatatggcgcaaatcaacgactgcggacaccgcgccgccgcgccttacgatgatgtggtgtattgggatttcaactggcgcaaaggcggcggcagcgcgcgcatgattgaaatcagcaaacgtgaaaacttctaccagcaggaatattgcggttgtgcctattccctgagggattccaatgcccaccgcaaatcacagggcagaatccccatcaaactcggcgtgctgtattacggcgacgaatcgacacaatacgaacctgcccccatccgggtggacaaataaacacccgatgccgtctgaaggttcagacggcatcgggttcggcatcggcacggggaaaggtttgccggtttggcaatctgcaatcggaaaccgcattggcaagtttgccgttttgataaaacaccccgttgccgcgtcgggaggacggcattatgaaatccctttttattcggctgctcctgttgggttcggcggcaggcgttttctaccatacccaaaaccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcagcggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgctttttccgctcaagcctttggaatacggcacgctttatacggcggtattcgactatgtccgcaacggacggcgagcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacgaggcgggcggcatcgtcttcagcgttgacggaatggcgggcagccgcatcacgcttgcaccggaaggagaaacggaacgaggcgtaaccctttatttacaggattgaatacatgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactgaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagcctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatgaaaaaaacctgtttccactgcggtctggatgttcccgaacacctccacctgactgtccgttacgaaaacgaagaccgcgaaacctgctgcgccggctgtcaggcggtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaagcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggtggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgaccgaccccttgaaagacagcgcggcggaggcggtgcggcagttggcaggcaaaaacctgaccctgcacatcctcagcggcgaccgcgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatgacggacggcgttgctttagacgtatagttgatgaaaacaaaaataagacgatgaagaattgcaaacttaaagtatgtattgttaccgctcaaacacgttggcgttcaaaatttgagatcgaattgctaggtatttgattttattaaataagagattgtattaatgaggaaaaaaattaaaaagtggatttatgcgataaatggaataatgatgtcaatatggattattttttttccaaataccggttctgtgtatgacggtggcagaacaaccattttcaatgaaaaccatccttttcattttattttctgcataacatttcttattgggacaatttttcttatatatcatgaatataatgataactaatttttaacatccttattgttatatcatgatgaaatgacaataaggatggttttctgctttggctactgcagaacaccgtcgtcagtctcgcgtaggggggaatccatatgcttggtttttcttttattttcaaatgctaattaacggataggtctggattcccgcctgcgcgtgaatgacggaaatgtgcatttctaatttttacccactatatagtgaattaaatttaaaccggtacagtgttggctcgccttgccgtactatttgtactgtctgcggttcgccgccttgtcctgatttaaatttaattcactataaaaaccccgaatcctgattggcaggattcggggtttttgattgctggtgccgttcagacgggattttcaaacagcttattgatctacaaacgcacgctcaatcaggtaatcgccgcgtacgcctgttttcggagagacggtcagtccgaaatcgtccaaaactttgcaggtatctttcagcatcgcggggctgccgcacagcatggcgcggtcgtcttgcgggttgattttgggcaggccgatgtcttcaaacagtttgccgctcaccatcaggtcggttaggcgaccgtggtgttcgaattcttcgcgcgaaacaatcgggtagtaaatcagtttttctttaaccaagtcaccgaggtattcgtgttcgggcaattctttggtaaagcggtcgtagtacgccaaatcttttttgtagcgcacgccgtgtacgaggatgattttttcaaattgctcgtaaatttcggggtctttggtgatgctcaagaaaggagcgatgccggtaccggtgctcaacaagtaaaggtgtttgcccggattcaggtcgccggcaaccagggttccggtcggttttttgctgattaacacgtcgtcgccgactttgaggtgttgcaggcggctggtcagcgggccgtcttggactttaatgctgaaaaattcgaggtgttcttcccagttggcggaggcgacgctgtatgcacgcatcagcggcttgccgtccaccatcaatccgaccataacgaactgtccgttttcaaagcgcaacgattcgtcgcgggtgcaggtaaaggtaaaatatgcgtctgtccagtggtgtacggacaatactttttgggtattgaatgctgccatttgggtttcctgtcagtaaaagaaatggatagtgcttgttcgggaggtgcggcagagtggaaatgtctgcccgattcgggataaagccaaaattctaaacgaaacggatggttgcgacaatgcttgatgcgcgttggttatatgccgtctgaagggcttcagacggcatcgcggggcaggcggcggcttacggcggcatatcggcaagggaaatcagggaaatcgaggctgccagcctgagtgcgtcccgtccccagcgggggtgttccagcctgcgtatcgggaggatcggtttgacggtggcggcaatcagcttttgtatttcggcaggctgatctgacaatacgccgccccatttttccgcagccgcttccagcagtccgccgtttttcaatatcagcgcggtcgaatggatgtagcagagccaatcgcgggcttggcattgcgctatggtcaggacttcggaagggtcgtcttcaaaatccaaaaagctgatgttttttccgtccgacatcatatttcgcgcaaacgcctgactgaggaactgccgttttttatgcacgcgtgcaatggcttccaaaccggcaagccaagcgtccgactttccagcctcggcttcttggcggatttgcgcatcgagcgggatgccttccaaattgccgaacataagggcatttttcctgacggcgagcaattcgggaacggctatccccgccgagcgcaattcgtacaggcgttttgattcggttgcaatggcaggctcgccgccgaggctgggaaccggcttcaacacccccagtttcaaatatcgggcaaccataccgagcagcgcgtaacgccatcgtgcattgtgcctgcctgctttgcgtatccataccttggttccgtcggcaagcaggtggggggcgatggctgcctcctgttttgccgccaattcgtctagcagtatggaaaaacgggtttcctgcataggtaaggtcattttctttcaatcttaagttcggacggaatgcccctgtacggaatatcaggcaagggtttgttcgatgatgccttttaccgcatccgcactgttcggcacggtttgcacgcgctgcggcaggttttccaaaccttccagcgcggcagggcgcggaatggcggcatcgccgacggcttcgcgtatggtcgcatcgaatttcgccgccaacgcggtttccaaacaaaccaccatttcaccttcttcgcgcacttcgcgggcgacttttacgccgtcggcagtgtgcgggtcgatgagttcttggtcttgctcgtaaacctgcttgatggtggcgaggcggtcggcgtgggtggatttgccagaggtaaaaccgtatttgccaccgactttgtccaaggcaaatcgcaggtcaaagcctttgcctgcagccacttccgcccacagcgtattgatttccgcaggatcgcgatccatcaggtcgaacacgaaacgctcgaagttggacgctttggaaatgtccatagacgggctggaggttacataagtatgcgcgctgttgcgcgggcggtatgcaccggttttgaaaaactcgtccaacacatcgttttcattggtcgcgacaatcaggcggcggataggcaggcccatttgtttggcaatgtgtcccgcgcaaacattgccgaagttgccgctcggtacgcagaagctgacggtttcgtcattgcttgaagtggcgttgaaatagcctgcaaagtaataaaccacttgcgcgacgatgcgtccccagttgatcgagttgaccgtaccgatatggtatttttccttgaacgcggcatcgttctgcaccgccttcacaatatcctgacagtcgtcaaacattcccttcacggcgatattgtggatattctcgtcttgcaggctgtacatttgcgcgcgttggaacgcgctcattttaccgtcgggcgacaacataaatacgttcacgccctttttgccgcgcaaggcatattccgcagccgaacccgtatcgccgctggtcgcgcccaagatattgagttttttgccttctttgtttaaaacatattcaaacgcattgcccaaaaactgcattgccatatctttgaacgccagcgtcgggccgttggacaaggcttggattttgatgccgtctgaaagcgtgcggacgggggtgatttccttagtaccgaacgccgcttccgtgtaagtacggttcagaatgtcgcgcaaatcgtcctccggaatatccgtaacaaacaggcgcataatttcaaacgccaattcgggataagctaaaccgcgccatttgtccaaggtttcgcgcccgatttgcggataatgttccggcagcatcaggccgccgtcgggggcaagccccatcaataaaacttcgctgaacggtttgtgtgcggtttcgccgcgcgtgctgatgtatttcatgatttttctcgtctgtcgaaattgcaggaaaacggcttcagacggcatctgcctcatgccgtctgaagaaggttagcggtacaggtgtttgaagcaggcggaaaccgttttggcggtcagggcggcaagtgcctgattgcgcgtggacggagccagcatctgcatcacatcgttgccggtcatccgttcgggtgcttcttgggcgacgcaagcgcaaatcttgttttcccactccgcctgtttttcggcactcatcgccagcgcggtcaaacgccattcgctgcgtttgtccaattccgcacggcattggctcccaaccgccattttgacgatgctgccgcccatgcctgtgccaccgtctaagctgccgaatgtgttaccgcctccggcggcgcagccgccgagtaagattgccaccggcaaaatagacaaggttttattcatctcaattccttttcggttgaaaccccgccttttatggcgatagaatctgattagccgccccgttcgggataacgcgaagggcggcgttttatgcgccgttccgagtgttggaacaaaccgttttgaatatccggttgaagcccggcaacattatacttcaatcgggaaaataaaaaatcccgccgccgtcattttgcctgtttgcaaaaatgccgtctgaaagcggttcagacggcatttccgatttcagcctagcccaaagatttgaagtgttccaaaaacggcgggataccgggcagcatcccgaccgcacccatcgccacacacaagatcaagaaacctactgcgggtatcaacacgcgtccggcgaaacctaattgcgcactgcgctctttgcagccgattaagcccaaattatccaacagcatcgtcaacgcccagccgaaaaccggattgaccaaggcggaagagaacaccacgatggcggcggattgggtggttttgcctttgcgcgtcatttccatgcccgcttccaaaagcggtaagtatacgcctacgaccaaggctacgctcaataccggctgccaaatcgccaagtccatcggatagccccataacccggcgataatacataaaaccgccgttaaaaccgcaccgcccggaatggggcgtttggcaatcgatgccggtacgatataagttccccaagaagaggtaaaatttgcaccccctaaaatagaacccactgcttgacggacagaacaacttgtcatggtgtcgtctatattcatcaataccttatcggttttttccggatagctgattttttggaacacttgatgtcctaaaaaatcgggcgaccacattgcaacagccaataccgcaaatggaaagacaaccaaaaaactttctgccgtcggcaaccccagatgccagccgctgttttcaccccaccaataagcaggactcattggaggcaggccgggggcggtgtgaaactcaaacggcgcacccaatgcaaatgccaccacaccggcaatcaagcatcccaaaggcacggctaaccagcgttttttccaatgctccaacaaagcgtacatcacaatcgttacaataatgacggtaaaagcgatgtagggcatattaaaaccgcctgcccacgaaaacaatttttttacctgccccgtcgtgccgataaagcccaaatagagtaataatccgccgcatacgccgttgcttgtcagcttcgccataatactgccgccgcgaaataaagccatcagcagacctaaaaccgcaatcgaaatgccgaacgccaaaggatgcccgcctgccgacacaacgatgggaatcatcggaatcagcggcccgtgcgtaccgggcaggttggcgccgggcagaaaaaagcccgataccaataagataaacgcggcggcgattaaaagctcatagcgcacattttccagtacaaagctgtcaggcagccccaaaggtgcggcaaacgccgccgccaccgcccccaccatcaccacttttccaatcgttcccgccatcgcaggaatcaaatcctcccactcgaagcggtaatcgcgaaagggcaggttgggccgccagcgttttggttgcataatctgcaattcatgttccaaatattcgtcccgcgtcgcaaattccgaagctggacggtgcaaatcccgataagtcccattatgtttttccataaccttcctccttatatatcgcgcctcgtaaaaggggcgcatgacttttctttttgatacgggctgcgttcggaagccgtaaccccatttaaagcccaaacaggcaataaaaccaatctttttttttgataaccatcatccggaaaactgatacaatttacaaaccacttgattaaaaagttaattttcagcaacaatccacctaaaagatttcgattgcacaaatatagaaaacatccgcacaaggagggatatatggatgccgtacaattaaaatcatttgtcgccgtcgcgcacgagggcaaccttacccaagccgccaaacgacttttcctttcccagcctgccgtttctgcccaaattaaagcccttgaagaatatgtcggcacgccgctgttcaggcgcacggggaaaggcatggtattgacgcgggcgggcgaaatactgttgcccgaagcggaatccctgctgcaatacaaacacaagctggagcattttgccaaaacgctggcaggcgattattcggaagagaccagtttgggcattatccaccccatcgattcggcaaaactcgtcgcgctgacggacaatatcggtcaaacagcccccaaaacgcgcctgcacatccaatacggaatgagcggcgaaatcctctcgcgcatccaacacaaaaccctgcacggcggctttatactcggcaacgccgcccaacgcggcatccgcagcgtattcctgcaaaacctgacctacgcgctgatttgcccgcaaagccaatatccccatctgacccgctcccttccgcagagcctgcaagaatgcgtatggatagaaatgtcgggcgtgtccggaagtaggaagcacctgcaccagttttggcgcagcaaccggctctcacccaaaaaacagatcttgtgcgactacccccaaaccattatcgatttggttgcaggcggtataggtgtggcaatggtgccgggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcattgaaaaagtatggggagtgcaggcggtgcagccgcccgttgtctcggacaactgaaataaatcctgctttgctgattgttttaaaatagaaatttgaattttatcacgctgaaaacactgaaaacgccatccgcattctctcaaatacggcttaaaatgccctttggaaatgccgttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaactgacgcaaataccgttttgcacaattccaaaagttttcaattccgttaatgcgattttgccgtttggcgaaatgcgtactgttccagtcgtggattgaacccccaccctgtatagttctttcgaagcattggggtattgttttttcaaagcatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgtcgtttgaacatttttttcttcctgtttgatttcagacggcattgccgttccgtttggtttccagcagctcccagcgttccagcttttccaaaagcagcatttcgatttcttcggcgcggttttgcaatgcacctgctttttcgtaatctttgaaaatttcaggataggaaagttgggtattgatttcagcctgctcggcttccaaagcggcgatttcgtcgggcagggcatcgagttcgcgctgctctttgtaggacagtttgaccgtgcggttggctttgggtttttctttggcgggttcggcatcggatgctttgggtgcggatgccgtctgaattttatcttcccgcgattttgcgtcgatatagtcctgatagccgccgatgtattctttcagacggccttgtccttcgaaaacaatgctttgggtaattacgttatcaaggaacatacggtcgtgcgagacaaggaatactgtgccttgataatcgcgcaacaggtcttcgagcagctcttgggtgtcgatgtctaagtcgttggtcggttcgtccaagaccaggatattggcaggacgggtaaagagttttgccagcaaaaggcggttgcgttctccgccggagagcgatgaaacagggctttgcgcacgggctggatggaacaggaaatcttccaaatagctcatgacgtgttttttcttaccgccgacttcaacgtaatcgtttccctgtccgagggtgtaaaacacggtgtcgttttcattcaacgcgctgcggaactggtcgaaataggcgacttcctgcttactgccgatacggattctgccgtaggtcggctgcaattcgcccaaaatcagcttaaggaaggtggttttgccgatgccgttggggccgattaggccgattttgtcgccgcgctgcaagatagcggagaatttgtccataatgactttgccgccataggcaaacgaagcgtgttccaattcggcgatgattttgccacttttctcaccgctatcgagcttgaagttgacttgtccctgtacgttgcggcgttctgcacgctggcggcgcagctcttccaaacggcgcacgcggccttcgttgcgggtacggcgcgcttcgatgcctttgcgtatccatgcttcttcctgtgcgtggaatttgtcaaagaggcggttgtgttccgcttcgactgccaactcttgcgcttttttctcgctgtatttagagaacgagccgggataggaacgcaaaataccgcgatcgagttcgacaatccgcgtggcgatattgtccaaaaaacggcggtcgtgggtaatcacaaccaagctgccttcaaacgctttgagcagattttccagccaaataatcgcgtcgatatccaaatggttggtcggctcgtccagcagcaatacgtcgggcttttgcacccaagcctgagccaaggcgacgcgctttttctgaccgccggaaaggttgccgattttttcattttccggcaaaccgagttcccccaaagtctgcttgactgccgcatccagtttccagccgtccttcgcttcgatttcaagttgcaattcgttgagttctttcaacaaagcctcactcgaaccattttccaactcatggctgacatgatgataacggcgcaataaatcacgaatttcgcccaaaccttcggcaacggtatcaaatacggttgcgtccttatcaaaaaaggattcctgcggtacataaacgattttgaggttgttttgaacaataatctgcccgtcgtcgagcttttgcaaaccggcgaggatttttaaaaacgaagacttgcctgcgccgttgcgtccgattaagccgactttttcgccgctgtcgagttgaaaagaagttttgtcgagcaaggcaacgtggccgatggcaaaagaagcgttttctacagataatatattcatgatacaaattctcaacagttaccgtttggattttaccgcaagtttggcgcgggcaatttcaaccgcacccggcaggacggaaacaataatgatgccgcccatcaccaagcccagattgttttttacgacggggaagttggcaaagaaatagcccgcgtaagaaaacaggataacccacaacaagccaccgatgatgttgtagcggataaatttggcatagtgcattttccccataccggcgacgaagggggcgaaggtgcggacgatgggcataaaacgggcaatgatgatggttttgccgccgtgtttttcgtaaaaacggtgggttttatcgagatattcacgtcggaagattttagaatcggggttggcgaacagcctgccgccgaaatatttgccgacggtaaaattgagcgcgtcgccgagtatggcggcaaggcttaataatgcaaccatcaaatgaatatccataccgcccagcgcggcaatcccgccggcggcaaacagcagcgaatcgccgggcagtaagggcgtaacaatcaggccggtttcgcaaaaaacaatcaaaaacagaatcgcataaatccacacaccgtattgcgccgacagcgcgagcaggtgttggtcgatatggaggatgaagtcgatggcggaggcaagcacggcgcgttcctaaaaaaacaaaccgcgtattttaaccgattggaaaaatgccgtctgaaaagtttcagacggcatcggctattcaaattcatttcacgtaaaaaccgcaaaccaaaatagtttgcggtttggcatttaaagtgacaatgatgatttcaaatcatcagaattttatgccgacgcgcaagccgtattcacgaatactggttttcgggatggtgagcgatacgtcgccactcttggttgttacactaaactcgccggattctttgtaagtgcgttgtttgtagaacggccccgcctcgatgctggcggattcgcccagttttttaccaatatttgcacccaatccaaagccccagccgttggttttttgattgatgtcttttttgagattggtaacgccggtgtttaatttatagcgggaattgaggtcaaatttcacttcagaccaagggttgatataccagccgttacccagttgggaaagcaaatccgcgtgaactttggctaaccacgactgacggctgctgtgaagcgtatgcttggtggttttaatgctgtcttttgaagattcaaaacccaagccggcacccacacggaaatttaaagaatcacttaacgtttgggtgtaggtgtagcctgtgtaaagatcgatacggttttcaggaacgccggtgggcagttttacatttttagtcttacccagcttgttctcatctgtttccaaattaataatattttttttgctgcgcccgaaaccggcttccaagcggatgccttggttggcatcaaaaggaatatcagcacgcacgctgatgtgtttggcagctttgtgtttttctttcaggaaagcacgagttgaagaaatggaagagaggtcggtgtggacggtaaactcattagcggtttgaagctcttgtgcagcggcggcagtaccggtcagggcaatcatggcacatgtaaaaactgtttttttcatagttaaaacctctaaaatttggattgtagtcggatatggtaacataacgtaaataatcgttacgcttacaattatattcttaagctttcggggggggggggattttacatatattaataaaaattaacaaatagttatttgtttacaacgaattgttattctcacttggttttctgttttttatgggaatgacgaaattttagtttgtgtgtatttatcggaaaaacagaaacccgccgccgtcattcccgcgcaggcgggaatctagaacccaacgcgacaaaaatttatccgaagcgacaacaatcttttcatcgtcattcccgcgcaggcgggaatctagaacgtaaaatctaaagaaaccgttttacccgataagtttccgtgccgacaaacctagattcccgcctgcgcgggaatgacgggattttaggtttctgatttcggttttctgttttaagggaatgacgagacttgagatggcggcatttatcgggagcaactgaaaccaccctgccgtcattcccgcgaaagcgggaatctaggttcgtccggtttcggttatttccgatagattcctgccgcgttgggggtctggattcccgcctgcgcgggaatgacgggactttaggtttctgtttttgtttgagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgtttggtttgcgtttccgtcagcggacggttgcggcaggctttgcgcataatgccgtccaacaactgatgttcttccagatgttgccggttttccgcactgtcatagcctttgtcggcatagacggtcgtacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttcttgatccaacgggcatcgctgtccttactcggtgtggtttggccgttgatttgtccttcttcatcgacttctatgacctgacgctgtgtgctgccggcggtctgaataatggtggcatcaatgacggcggcggatgctttctctacttttaagcctttttcggtcagttggcggttgatcagttccaataattcggacagggtgttgtcttgcgccaaccagttgcggtagcggcataaggtgctgtaatcgggaatgctcagttcgtcaaaacggcaaaacaggttgaagtcgatgcgggtgatgaggctgtgttcgagttcgggatcggagaggctgtgccattgtccgagcaggacggctttgaacatggacaacaggggataggcgggacggccgcggtaatctctgaggtaacgggtttttgacggttcaggtatggttcgatcggctgccaatcaatcacccggtccaacttcaatagcgggaaacggtcgatgtgtttggcaattatggcttgtgcggtttgccggaagaaggtgctcatgagaaatcccctaaatgtcttggtgggaatttaggggattttggggatttttgcaaaggtttccgcctgaaacattatgagatttcaggcggcattggattgcttggcggaatatttttaaaaaggcttacgcgccgtaaacggggtatttattgcacaaagcagttacttgtttgcggactttggcgaggttggcttcgtcttcggggttagacaatacgtcggcaaccaagttcgccaatacgcgcgcgtcggcttcgttaaaaccgcgtgtggtcatggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatagtgcgccatatcgacaaagaggtatgcgccgactttatcggcgatttcgcggaattttgcccagtcgatttgtaacgcgtaggcagacgcacccgccacaatcattttgggtttgtgttcgagcgcgaggcgttcgacttcggcataatcgagcacttcgttttcatccaaaccataagtaacggcgttgtagagtttgcctgagatattaacgctcgcgccgtgggtcaggtggccgccgtgcgctagagacatacccaaaatggtgtcgcctggttttaaaacggaagcgtacacggcttggttggcttgcgagccggagtgcggttggacgttggcataggctgcgccaaacagttcttttacgcggtcaatcgccaattgttcgacaatatcgacgtattcgcagccgccgtagtagcgtttgccggggtagccttcggcgtatttgttggtcagctgggaaccttgcgcgtccattacggcgcagctgacgtagttttcggaagcaatcagctcgacgtggtcttgctggcgttggtcttcttgggcaatggctgctgccaaatcggggtcgtattgtgcgagggtaacgctttttgaaaacatgttctcggctcctttgtgtaatcagggtatcatgagtgttttttgtataaaaaaatatttcaaaacctaaggcagatagcccataatgcgtaaattttctttggcattatcaggtaatttatttaacatgctggtttttagcgtctcattacctttatttagtacaagactaatcaaaagcaatacattaaatggtaaattttcggcagtttgtgcaaaatcaatcaaataaccagcaccaaccacatctttatcagccataacccgctgatacaccacttgctaagacaactctcctgccccaccatgtcttaaaatcagatgaatggcttgtaatgctgtgtttggtgtctcacaaattgccaagatctgctcagaagcttgcttgatggcttgtatttttgtttgattactcacaatttccccctattttaataattaacttaaatgcggtcaaattcacaaaatacaagctttacctctaatcacccatcactcgaccttctcggcgtggatcggcaccaccaaccagcctgcttggctcgataataatggcttgaacacctgaatttagctcacgcacatcagtcttatagcccaaatcatttaatgcttgttgccactggacggcggttgtacccgtttctagttcatagctaccaaagcgatttaataaattgggtgcactgatggcattttggatatccatattccagtcactatgtgccacaatcgtcttagcgacatagccaatgatacggctaccacctggggagccgattgccatataaggcttgcctgctttaaatacgatggttggtgccattgaggagcgtggtctcttgccgggctcgacacgattggcgacctgtttgccctgctttattggctcaaaactaaagtctgtcagctcattattcagcaggtagccatttgccatcaaagttgagccaaacgcattttcaatggaagtcgtcattgatagcacattgcccgccttatccacaattgatatatgactggtagaaggtaactcaatcgcttgtgaggacacccactcatgaataaaatcgcctgcagatacgctaggcaatgccttatccgactgctcaagcagctggctgcgatgttttaggtagtctttagaaatcaactggcgaatgggtactggtacaaaatcagggtcgcccaaatatacatcacgatccgcaaacgcaagcctagaagcgtcgcccaagagacgtaaaccttcagcatcataccccacctgattgggtgaaaattcatttaaaatccccaaaatctgacccacagcaatcccacctgagcttggtgcacccataccgcatacttcataaatacgataagtcacacaaacaggcgggcgttccaccacttgataatcagataaatcttgtaaggataattgaccggggttatccttagcattttggacaactgaaacgatattttgggcatatttaccagtatgcagagcttttgcaccttgagctgctaacgcctgaacactgtcagcaaattctaaatttttcagcaagctgcctgcttgtagcggcacaccattcggcaaaaaataagcggctgtttttggatagcgtgccaaatgctgctgattttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccgaccaccgcttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaatcacctgcttttgttcggtcagtcccgttgcatgttcaggcgtgtgagcgtctgcacctgtgatgacagcagaatgagtattaaccttaccttgattggcatggatgacttgacatccagagattgtcatagacattatcaatgcagtcaataaatatgttttagccacaagcactccttcgcctgagtttgattgatgattcatacaaggcatgctgattattgtatttaatatggctaaataattcaatccaaactatcaatcttgaccatcaaaaaaagaccgctaatgtcatcagcagtcttttttgatatttattttaagatattaagtaatcagacctttgggctatgctcttcaatgagtggttttagctcacctgattggtacatttgtaggataatatcactaccaccgattaactcaccattaacccaaagctgtggaaaggttggccgactggcgatgagtggtagagtactgcgaatttctgggttttctaggatattaacaaaagcaaagggtctgccaattgggtcagcacctctactgcacgcgctgaaaatccacattggggaaactggggcgtgcctttcatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacagtaggaaaggctgaaaatttatgcgtaaagcgtgatattgtcaacgtttttatcaaccggacggcggtgttaaaagaaaattttgccgtatccgataaaacactggataaaaatattatctttgttataattaatgtaaagattcaatttgactttttaaccgtaaaccaagagaggaaagcgatatgttcccagaataccgtgatttgatttccaaattgaaacaggaaaattcccgcttcgcccgtctgttcgacgaacacaacgagctggacgataaaattaccggtctggtcaacaatccggttaccagcggtgcggaaaccatcgatgagctgaaaaaagccaaattgaaactgaaagacgagttgtacgccatcctgcaaaaagcagcgggaaaataattcgggtttgagtttttgaaatgccgtctgaaatgtgttcagacggcatttttgtcatttgaccggaaggcttgtgctgtttgaaataacggcggcggtatcggattgccgccgccgtgtacttgtgtgaacggctgtctgtctattttgcgtgcaggcggtcgagataggcgacttcttcgctgctgcccatgaagacggcgacgcgttggtgcaggttttcgggctgtatgtcgagcatggcttgatatgcgttgcttgccgatgcgcccgcctgttcgagtatcaggctcatagggttggcttcgtacatcaggcgcagtttgccgggtttagcggggtcgcgtttgtcttgcggatacatgaacacgccgccgcgcatcaggatgcggtggatttcggcaaccatactggctacccagcgcatattgtagtttttgccgcgcgtaccggtttcgcccgccaagagctcgtcgatgtattgttggacggggggcagccagtggcggcggttggacatattgatggcaaattctttggtactttcgggtactttcgggttttctttggtcagcacaaattcgttttcggcattgagcgtgaacatatatacgccatgtccgaatgtgaatacgagctgggtttgaggcccgtaaagaacgtaaccagcggcaagctgctgtctgcccgtttgaaggaatgattcggttgccaatgcgccttcgggtttttcaaggatggagaaaatcgtaccgacggaaatgttgacatcaatattggacgatccgtctaaagggtcgaataggacgagatagcgtccgttttcaccggcatttacgaaagtgtcttcttcctcgctcgccagcccggcaacggcagaattggctttgagtgtgtcaatcatgatgttgttggcgataacatccagttttttttggtcttcgccctgaatattgcccgtgcccgccatacccaatacgccggccagtgcgccgaggcggactttggcgttgatttcggtgcaggcggaaacaacggacagtaaaacgccgccgagtgcttcgggcagctggttttgttgcaggtgttcggggaggaatcgggtcagtgtgtccatagtttgctcgtttcggaaaggtttgtgccgtctgaaaggcggcaggttattgtggcgtattcctttggtgcgttttgcaggatagtctaggggattgtagtgtaaaaaaacggcatggggcaagtcggaacgcggcaggcggatgaggggatatttattcttaaaagtgccgactgccggtatatcgtccggttttgtttatttgacgggagatgttgtctgaagggtttcagacggcatcggggtcagcggattttgctgtccaaaaggtagcgcgagccttcgtcttgcgccagcagccgcgtcagggcggggaggtttgccgccaattgttccgccaacagatagggcggattgatgacgaacattccgctgccgtgcataccgaaaccgtcggctttcggcgcgtggacgtgaagttcggcgtgaaggtagttgtcgggcaggagttttttcaattcttcgggcagcttgcggctttcttcgcggctgaggcagggataccaaatgagataacagccggactcaaaccgttttaaagcggctttcagcgtttccgttacacgccggtagtcctgtttttcctcatagggcgggtcgatgaggacggtggcgcggcgcggcgggggcggcagcagggaaatcagccctttgtaaccgtcttcgcgtaatacttgtccgcgtttgcccaatcctgcttcgcccatattgttttgcagatggacaaagtcggtggggtgcagctcaaacaggcgtaatttgtcgccgacgcgggtcagcgattgcgccagccacggagaaccgcagtaaagtttgggcgagggcaggattttttgtatgtgcgcggcaaagtcagagagttcggcaggcaggttttgcgcctgtcggagcagggcgatgccttgtcggtattcgccgactttctgcgcctcgctgccttcgagattgtacacacccgcgccgccgtgcgtgtcgatgtaccagtagggcttgtctttgcggttgaaatattgcagcactaaaaacaaggtgaaatgtttgagcatatcggcgtggttgccggcgtggaatgcgtgtctgtaactgagcatagtcggtaaaacggcgggatattcggatgccgtctgaagcggggttcagacggcataaacagggatggatgggaaatcagcggctgccgccgattttgctttctctgccttcgagcagcttgacgatattacttttgtggcggaacaacaccagcaaagcaatggcgacggtcgcccaaacccacgagacgtgcggcataaagaaggatgcggcgaccggtgcggcgattgtggcggttaatgcggcaagggaggacaccttgaagccgaatgccataacaagccaaatcaacgcgcagaccaaggcagttgcgggagagagtgccagaagcacgcccaatgccgttgccacgcctttgccgcctttaaatccgaaaaacaccggccacatatgcccgaccagcgcggcgagtgcgacggccgcgattgcgctgtcggataaaccgagcggttcttgaagcacgcgtgcaagcaaaacggcaactaaacctttggcggcatcgcccaagagcgtcagcgcggccgccttttttttgccgctgcgtaaaacattggttgcccccggattgcccgatccgtaggtgcgcgggtcgtccatgccgtaatacttggacacgatgacggcgaaagaaagtgagccgatcagataggaaacagcaacagccggtatgttgaacatttgcggtactttacttagaatggtgcggttattttagcaaaaaacggggcggattatggataaaatctttttgcacggcatgaaggcagatacgcttatcggcgtgtacggctgggaacgcgaacggttgcagaccctgattgtcgatttggacatcggtgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcgcgtgaaaatcgtcaagccgggtattttggaaggcgtgcgcgaggttggcgtggaaatcgagcgcggcaagcgtgaagattgaacggcagaataggaaacggaaaggagatatgaagtggatttgagggaagtaaaattaggcggcgaaaccatttacgagggcggtttcgtcagtatcagcagggataaggtcaggttgcccaacggcaatgaagggcagcgtatcgtcatccgccatccgggtgcggcatgcgtgttggcggttacggacgaagggaaagtggttttggtgcggcagtggcgttatgcggcaaatcaggcgacattggaacttcctgcgggcaagctggatgtggcgggcgaggatatggcagcgtgtgcgctgcgagaattggcggaggaaacaccttataccgccgacagcgtacgcctgctttacagtttttatacggcggtcggtttttgcaacgaaaaaatgtatctgttcgaagcggaaggcgtgcgtttgggcagtacgcttgccaatgacgaagacgagattacggaaaccgtattgatgtcgaaagaagaagtccgtcaggcattggcaaacgatgaaattaaagacggcaagacattaatcggtttgcaatactggttgatgaaggattgacaggatgttggacttgcccgccggattggatcggcgggcggtttgtttggcggatgggatatgccttttcggcttgtatctgggcgcgtcctttaaagtcattcgtgctttagtaataagagagaaaaggggatgataattacctaaaagaacgtgataatttttaaaatggttaataatgaatatctttgttactaatttttgttattggtttattagtttattggctatttcttatataccatctattaatgcatggcatgatgaattaatagatgatattaattttggcaaaagggttatgatggttactttttttgcatttttaggcacggtaatagagcgtttttttaagaaaaagccttggtggttttatcctgccaaggctttttctttgttacagacctaaaagctcaatttgaatttgagaacggtaattggcacagccagtatttaaacaagcgaagctaatttatagattatgtcaaaacaaagggaggcaatttgttgcggttatttgactgccgcccctatcttcagcccgagccaggtcagcagcagcgaacctgccgtgtgcaggaaaatattggcaagtgctgaagcgggacggttcaattggagcagggttacggtttccagcgaaaatccggaaagcgtggtcaggctgccgagaaaaccggtaatcagcagcagcttccattgcgggtggttgacggtttcggcaaagattccgataagaaaagcgcctatccagttggcaaacaggttgcctgtggcgggaggtattgatgcgggaacggcgaggttgagcagccaacgcgccgttgcaccgagtgccgcaccgatggaaagggggatgatgttggaaagcatggttttgcctgtctatgccgtctgaaggctaccgccatatgccgcggtcggacttaagatagcggttgtcgtcgaaagtgttaatccaatggggcttcagtgcaacaaatatggcagttgaaatgccgctgaggaaggcttccgcccacgccagcagaataaagacgggcagggcggtcgtccacaatatttcggacggaaaagcgtttgcggcatccaaaataccggtcagcaccagcccggtcagcagaatgccggcggcggaagcgagaaagccgttgacgaaaataaagatgaaaatattgggcggcaggcggttgaccagcatacgcgacaggcggttgacggtcagcgcgggcagtatcagcaccaaagcgttcggcggatatgcgccgacagaaccggcaaacagcaggcagtagggcagcatcagcagcgcggcaagccaaagggcggcggaagtgcccatcatcagtgcaaccaaattgacggcgagcaggtggtagttcatctgggcaagctgtccgccgccggcagaggcgttcagacaccatgctgcggaaaaaattacggtacacaggggaagggcggaacggtagcgggcaagcgagcggaatgccgacggcgcggaagctgccagtatcaggataaggacaatccacgaaaccgacagtaccatatctgaaaaccagactgtttggaaaatcatggcaatgccgcaaagattaagggaagggacggctattatactgtcggcgggggcaaaccgaaagccgaatcggtttcggcagaattgccggccggttgttttttttgggatggaaacacgttaaaataaacccgtttaatcgtttgtcttgcgggaaacggcatatgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttgattttttgcaaatggaaatgccgtctgaagactgtttcagacggcatttttatagtggattaacaaaaatcaggacaaggcgacgaagccgcagacagtacaaatagtacggaaccgattcacttggtgcctcagcaccttagagaatcgttctctttgagctaaggcgaggcaacgccgtaccggtttaaagttaatccactatatcagacatttgaattcggattattccctgacctgtcccgtgccttgtacgatgtatttgtaactcgtcagctctttcaaacccatcgggccccgggcgtggagtttttgcgtggagatgcccatttcgcaacccaagccgaattcgccgccgtcggtaaagcgcgtggacgcgttgacatacacggcggcagaatcgatatgagtcgtgaaatagtccgcagcgtggcggttttcggtaacgatgccgtctgaatggtgtgtgctgtgggtttcgatgtgccagaccgcctcttcgaccgaagcgacggttttcacagcgaggatgtagtctaaaaactcggtatcgaaatcgtctgcacccgccgcttcgccgccgatatgccgcgccgcctgcggatccaaacggaagcggatgggcggcagtccggcttctatgcggtcgcgaaccaacagccgttcgagcttgggcaggaagtcggcagcaatgtcttcatgtaccagcagcacttccatcgagttgcacacggacggacggctggttttggcgttgtacacgatacggagcgccttgtcccaatccgcgtccttgtcgatataaatgtggacaatgcccgttcccgtttcaatgaccggcacgacggcattttcaaccaccgcccgtatcagccccgccccgccgcgcggaatcagcaggtctagataatctttcgccctcatcatttcgtaactgctttcgcgcccggtgtcttcaatcagttggagcgcgtcggggtcgatgcgggtttgcgccaaccccgttttcagggcggcaacgatggcgcgtgcggattggaatgcatctttgccgctgcggagtacgaccgcgctgccgcttttcagtgccaaagccgccgcatcggaagtaacgttcgggcggctttcgtaaataatgccgataacgcccatcgccacgcgctttttgacgatttccaagccgttgggcaaagtcgaggtttccagtatttcgcccacggggttgggcagcgcggcaaccgccctgatgccgtccgccatcgcgcaaatgcgtttgccgtccaacaaaaggcggtcggtcatgctttcgggaatgttgcctgccgcggcttccaagtcttgacggtttgccgccaaaatatctgccgtcgccgcttccaagctgtccgccatcgcaagcagcgcgcggtttttttcttccgtatccgccgtgttgacggatttttttgccgctttggcaagggcaagctgtttttgtgtgtttgacatgggtttccttttctaaaattcggtcagaagcaggcgtatttcgggcgtgatggaaatccagtcgtcccgatggatgaacacgcctttcgccttacgcgatttgagcaggtcttcggcggcggcagagccgaacaggacgcgccctttgcccaggggctgtttggttgccttgctgtacacggttacggtgtccatacgggaaaaatgcccttcgattccggcaatgcccgacatcagcaggcttttcccctgttcggacaaagcgtgttccgcaccttcgtccacataaacgctgccccggctttcggaatagaacgccagccattgcttctgcgtccgcaaacctttggcacgggggacgaaaaacgagccgtccgcctgatgttcggcagcttcggcaagtgcatcgggtttgagcgaggaacagatatacaccggtacgccggattcggcggcgatggttgccgctttgattttggtcagcataccgcccgtgccgtttgccgaacccgagccgcccgccatttcgatgatttcatggttgatgtgttcgattttgtccagccgtacggcatcgggattgctgttcgggttgcccgtgtaaagaccgtctatgtcggtcagcagcaccaagaggtctgcctgtatcatcgccgccacttgcgcactcaatgtgtcgttgtcgccgattttcaattcctcaaccgaaaccgtatcgttttcattgatgatggggacggcgcggcgttgcagcagcacggaaagtgcgccgccggcattttggtagcggcgtttgtcggcaaagtcggcgcggctgagcaggatttgcgcggacacgatgccgtctgaagacaggtttgccgtatattcttccatcagcagcccctgcccgacggcggcggaagcctgtttgtcggcgattttgaccggacgttttttgaaacccagcgcaccgaaccctgccgcaaccgcgccggaagacaccaagaccagctcgtgtcccgcatgatgcaatgcggcaagctggcaggtgatggtttggattttgccgcgcgagagactgccgtccgaatgggtaatcgaagatgtgccgactttaaatacgattcttttgtatttcattgtttccgtccttgttggtttgtcctgtctcgttgccaccttgtgccgccgaatttgccctgttctgccgcaattgtcaacaatcacgccgcgtctgcaataaaatggacaaaatgtataaaattaataaaatctatggcggcttattgagatttttcaaatttatattgccgttttgtccaaaatgcgtataatcctgtccatatttctgctgtaggctgatttattttagacaaggactaccatgcaattagatatagaccgcttggttgcttatttcggcggcgtgaacgcgcttgccgaagcgttgaaacagcacgatcccgaaaatgccgcgacgaccgccgccatctataaatggcgcacgcgcggctcgctgcctctggcgcaactgcaaaagctgaccgcgttggcggaagcgcaaggcaggccgctggatttgaatgcttttttacaaaaaaacgaatctctggagagaacagaaatgacacagaccaaccgcgttatcattttcgacaccaccctgcgcgacggcgaacaatcgcccggcgccgctatgaccaaagaggaaaaaatccgcgtcgcccgccagctggaaaaattgggtgtggacatcatcgaagcgggttttgccgctgccagcccgggcgatttcgaggcggtcaatgcgattgcgaaaaccattaccaaatcaacggtctgttcattgtcccgcgccatcgagcgggacatccgtcaggcgggtgaggccgttgcgcccgcgccgaaaaaacgcatccacaccttcatcgccaccagccccatccatatggagtacaaattgaagatgaagccgaagcaggtgattgaggcggcggtcaaagcggtgaaaatcgctcgtgaatacaccgacgatgtggaattttcctgcgaagacgcgttgcgttcggaaatcgatttccttgccgaaatctgcggcgcggtgattgaagcgggcgcgaccaccatcaatattcccgataccgtcggctattccatcccgtataaaaccgaagaatttttccgcgaactgattgccaaaacgcccaacggcggcaaagtcgtttggtcggcacactgccacaacgatttgggcttggcggttgccaattcgcttgccgcattaaaaggcggcgcgcgtcaggtggaatgtactgtcaacggcttgggcgaacgtgcaggcaatgcttcggttgaagaaatcgtgatggcgttgaaagtgcgccacgacttgttcggcttggaaaccggcatcgataccacgcaaatcgtgccttcgtccaaactggtgtccaccattacgggctatcccgtgcagcccaacaaagccattgtcggtgccaatgccttttcgcatgaatcgggcatccatcaggacggggtgctgaaacaccgcgaaacttacgagattatgtccgccgaatcggtcggctgggcaacaaaccgtttgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcactggtatccgacgaaatgggcagcatgaatgccgagagctacaaattcatctcccaaaaaatcagcaccgaaaccggagaagaaccgcgcgccgacatcgtgttcagcatcaaaggtgaagaaaaacgcgcttccgcaaccggttccggccccgtggatgcgattttcaaagcgattgaaagcgtggcgcaaagcggcgcggctttgcagatttattccgtcaacgccgtcacgcaaggtacggaaagccagggcgaaaccagcgtccgtctggcgcgcggcaaccgcgtcgtcaacggtcagggcgcggataccgacgttttggtcgccaccgccaaagcctacctttccgctttgagcaagctggaatttagtgccgccaaaccgaaagcgcagggcagcggtacgatttgagcgtgaaaacagacgatgccgtctgaagcataaaaaggcttcagacggcattgcggcgataatagggcgcaaaacccatttgaaaaggaaaatgatggattcccgaaaatttaccgaagcatccaaacggcggttgagcgaattgttggatgccaaaagcgaacaaggcaacacgatgcgttgcgacgaggttcaaggttttatgacggcgctgttgagcgggccggacaaattgacaccgctcgactggctgcccgaagtgttgggcgacgaatcgcaatttaccgccgccgaacgttccgaaatcgaacggctggttttggcaatggcgatggaaacaaccgccgcgatgtcggataaaaaactgcccgatttgtggctgtatgaaaacgaagacggcggcagcgatttttacacatggtgcaatgcttatctttacggtttggatattgtgccgaccgattggtttgaagccgtcgatgatgaagcgtttgaagagttgttttatcccatcatggcattgggcggtatttacgacgaagaggaaaacggcgctatccgtctgcaattcacagaaggcgagctggcggaactggaatccgagttgccttatgcattggcggatatctaccgctactggcaggcagtcatcaacaaaccgcaaaccgtccgcagggaaggcgaaaaaacaggcaggaacgatccctgtccgtgcggcagcggcagaaaatacaaggcgtgttgcggtaagaattgaagcgtttgtttccatgaaccaaacgtaaaaataccgtctgaaaccggatttccatgtttcagacggtatttttcacaggcggtcagtgctgttttttcatgccgaaccggacaaagccgacgatacccaaaacaatcatcgggacgctcaaccattgccccatcgacagccccaaggtcagcagcccgagatagtcgtcgggttggcgtgcgaattcggcaatgaagcggaatatgccgtagccgccgaggaagagcgaggcgacttgtccggtcgaccgctgttttttagagaacagccaaatgacggtgaacaggcagatgccttcaagtgcaaactgataaagctgcgagggatgacgcggcagcataccgtattgttgcagccattctgcccaaagcggattgtgcgcggcggcttcggcatcttcgtaacgcgcctgcgggaagcccattgcccaaaatgcgttgatgtcggtaacgcgtccccaaagttcgccgttgatgaagttgccgatacgtcccgaagcgagacccagcggaacgagcggtgcgaccgtatccatcagtttgaggaagccgatgccgtgtttgcggccgaacaaccgtatggcaataactacacccaaaaagccgccgtggaacgacattccgccttcccataccttgaaaatatcaagcggatgggcgaggtagtcggaaaacttgtaaaacaggacgtaacccaaacgcccgcccaaaattacgcccaaaatgccccatgtcaggaagtcgtcgagcgattctttggtaaaaacggacaagccttgcgcgatgcgccttctgccgagaaaggtaaaaagaataaatccgaggatgtagcttagggcataccagcggacggcaagcgggccgatactgataaggacgggatcgaattggggatgggtaatcataacgggctttcgttttcaaatgccgtctgaaaggcatgatgcttcagacggcatttctgcaataagggtttcagcgcaaatcgccgatgacgttgaggatagcggacaacgcggcttcgcccagccgtaaagaacgctgaccgttccagccgaagtcgtcgtcgggcagattggcattgtctttgaacggcatttccagcgtataggcaaggcagttgaaacggttgccgacccagttggtcgccaaggtcatattcgcttcgcccggcgcatctttttcgtaaccgtattcgtcttggaaatcggggctggcgtttaaaagggcatttttaaactgcgcttccaacgcggcgatgcgcggattgtagttcggcacgccttccgtacctgcgacaaagacaaagggcagcccttcgtcgccgtggatgtccaaaaacaaatccactccggtttccagcattttttcgcgcacgaagaacacttccgggcttttttctaccgtcgggttttcccactcgcggttgaggttcgcgccggcggcgttggtacgaaggttgcccagtgccgaaccgtcggggttcatattggggacgatatagaacgtggcgcggtcgagcaaggcgcgggcggtagggtcttgcgggtcgagtaatctgccgagcagcccctcgataaaccattccgccatggtttctcccggatgctggcgggcggtaatccagattttcaaatcgctttcgacctgattgcctatggtcagcagattgatgtcgcgcccttgcacggtgctgcccaagtcgtcgatgcggcacaggccgctgccttgcgcgtcgccgaggaggtttaaatgctgttcttcggagtaaggttcgaaataggcgtaatacacgctgttggacagcggagtatgattgacggtcagtacgccgttttcgtaggaagtcggtacgcggaaccagttgcggcggtcgtatgaggcacacgcctgatagccttcccagcctttcgggtaggcggcttctgccgcgttttcaaaatgcatgatgcagttttgatatgccgcgccttgcagccggaagtagaaccattgtgcaaaatcggaggcgttgtcgggacgcagggcgaggcggatgttggaaggatcggtcaggtctttgacgacgaccgagccggcatcgaagcgggtgctgattttaatcatgggaaagtccttgctgtcgccggtttctcgaaccggataaaccgcgattttaccgcccgtatcgcaaggcttcaacctgcccgaaagtctgccggatgccgtctgaagattgtttcagacggcgtttggcgttaacataagccgaaattgtcaacaatagggagccgttatggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctgaagcaaagtcggaaaatgccggctttggcggaaaacctgtttgtctggtttctgtttttggggtttcgggcaatttccaaaccgtcattcctgaaaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatagaaacaaaaacagaagcctaagatccgtcattcccgccgggcatctggttttttgaaatccggttgtttgggataaattctccggctttgattttttgtttttccgataacgccataactttgaaatttcgtcattcccgcgcaggcgggaatctagacctgtcggcacggaaacttatcgggaaaaaaggtttctttagattttatagtggattaacaaaaaccagtacggcgttgcctcgccttagctcaaagagaacgattctctaaggtgctgaagcaccaagtgaatcggttccgtactatttgtactgtctgcggcttggtcgccttgtcctgatttttgttaatccactatacgtcctagattcccactttcgtgggaatgacgggatgtgggtttttgtgcggatttgaaccggtaagggtggtgtgggattggtggtttgcttaggatcttttggattgtattttgtatatacatttacttgttgataaaagataaaataaaattagaaactaaaagtgagaaaaaattaataataatagggatgtataaatgtaaaggctccgtttcatagctaaggttatctgaatatatggaaaaaaagtaaaagtccataaaactaaaatatatagataatgctaatgataatagaattatcactttcctagagtaaggataatatttttttatcgtaaaaaaatataaaataggataaataattgccatatagatagattttgtaacaaaattaaaaataaataataaaaataatgtaataaagtatattttttggctatgaaataaaattgtacataattgaacgagcagatcaaaaaatgaactacatataacaataaataataacgtatttaccatactaaatttaataggtctcattatcatatttaataaccacttcatagtatagtggattaaatttaaaccagtacagcgttgcctcgccttgccgtactatctgtactgtctgcggctttgtcgccttgtcctgatttaaatttaatccactataaatgcagagtgggtggaaacactcactttatggtttgctacgctctgctcaattagcaacccgataacccaatatggataatagggtaattaatccaatctaatttgtcagcatccgttaatttattgcaaaataaagtattgaattatgtcgggtgcaaatgacgaaatataagtttccgtgcggacggatcaagattcccactttcgtgggaatgacggtggaaagattgttgtttttcccgatgaattcctgtgttttttgtttttccggataaattcctgtggctttgagttttttggatttcagcctcaatgccgtctgaacgccgaatcgggcttcagacggcattgcgtcatttgaaattcaaaaccggccagcctttttctttggcttctttttccagctcggcatcggggttgacggcgacgggttcgctgacaaggcgcagcagcggcaggtcgtttttggagtcgctgtaaaaataggttttgccgtagctttggagcgtttcgccgcgttcggcaagccattggttcaggcgggtgattttgccttctttgaggctgggcgtgccgatgtaattgccggtgtagcggccgtcagaaccggtttcgagttgtgtgccgatgatgttggtgatgccgaaaaggtggcagacgggggtgatgatgaactcgttggttgaggaaatcacaagggtttcgtcgcctgccatttggtggctctgcaccagcatacgctgcataggcgagatgtgggggatgatgtattccgccataaattcgcggtgaaactctgccagctcttctttgctgtaacgagcgagcggggcaaggtggaatttgaggaatgcgtcgatgtcgaggcagccgttttggtagtcgcggtagaatttttcgttttgcgcttcggtttcggcagcgtcaaccaagccttttttgatgaggtattgcggccaggcgtggtcggaatcggtgttgatgagggtgttgtcgaggtcgaagatggcgaggtttttcattgggtttcctgttgtttcaaaagctggcgcaaaagcggcagggtgatgcgtttgcccatcgtgacggcgtagttgtccagcgtgtcgagcatcatcatcaggctgtccatatcgcgccgccagtgtttgagcaggtattcgaaaatttcggaatcgacggttacttggcgtgccgccgccatactggcgagcgcgtcgattttttcttggtcggttaagggtttgacttcgtaaacgaggcagtacgccatacgcgtccgcaaatcttcgcggatgacaagctgctggggcgtgtattccgaaccgagcagcaaaaagcctttgccgctgttgcggaagcggttgaagatggaaaaaagcagggcttgttcttcgttgcccagtttttcgacttgatcgacggcgaggtattccgcctcgaacgcggcatcggtcagcggcatggaggcggcatcgatataggcggcgtttttgccggcttcgagcgcctgtgcgacccacgcctgcaaaagatggcttttgcccgcgccttcttcaccccagacatagataaactgtccgtgtttgtgtcggaggacatagaccagttccgcgttttccgtgccgaggaatttgtcgaaactcggatagtcgtgtgcggcaaagtcgaaaataagctggttcacggttcggcattccgaggggtggtaaacgggtttattgtacgttgttttcgcgcgcctttccaatttgaacgatgccgtctgaaaacggcttcagacggcatcgttcaaccgcaggcaacgttgccgacatcgaggcgcatattgtggaacgcgttgagcgtgctgcggtggccgatgctgatgatgatgctgtcgggcagtttttgtttcagtgcgcggtagagcagggcctcggtcggttcgtccaaagcggcggtggcttcgtcgagcaggacgattttgggcttggaaagcagggcgcggacgaaggcgacgcgttgcagttcgcccggggagagtttgtgttgccagtcgtcggttttatctaatttatcaaccagataacccaagcggcaggtgttcatggcttcggctaactcgggatgctgcttgtcaatgtcggggtaacaaaccgcgtcgcgcaggctgccctgtgccgtgtacgggcgttgcggcaggaagaggatgtcttgatgcggcggacggctgactttgccgctgctgccgaacggccaaagccccgccagcgcgcgcaacagcgaggttttgccgcaaccgctcgggccgcgtatcagcagggaatcgccgtttttgaggtttatgttgatgccgctcaacaggatttcgccgttgtggcggaacagagcgacgttttcctgtgggggactgttagtttttgcacaaggaacaaatagagtaaaaaaacgctgaaatcttcggaagacgtggatttcggcgtttttttgtatccggaaaagttacgccagctttttcacaaaaccgcgccggaatgcgcggttttctgtttaaagctgacgagattagggaatttttaaaactgttttaagaggtttttaaaatggatttaatcaatactccggccataccattcaacacggcctatgatggcgatgtcgtcttgggcattgctcaaatctatttcaaacggtgcgtaacgtggattttcagacgttacaagcagtttgcccggtatacgttgcacacgtttgacaaagaggtcattgcctatacgcaagacatataggccgtcacgcgggtcagtttcggcgtggttgatgagaatggaatcctcatgattgagcacgccctccattgaatcgcctttaacggtaattacagacagtttttccggctgtttggtcacatagttgtcaatccaatatttccggaaagccaagcagaataaaggttcttcgccgaagactggtgcgccataccctgctgctgcggctacgttgtagcgcggcacgaatacaaactcggacaggtcgacaggattgcccatagtgtcggtgattccatcagaatttctacttacagagaatgctccggcgttttccggcctggctttatcgagatacggcaagccttttccggtcagcagccagtttaaatcacaactgaatttttactaggtaatcggctgttgggatagctccctctttccaaactctattaaatccagaagccgacatttctattttgttatagatgtcagatggcttagccccatgaggccaaagaaatttgagcctatctaaaaaagtatccatagtaatcctaatttaactcatttaagcaaaacattaagcaaaaaaagaaactcttttgcttaaataagattactcaaataatcaatattttgtaaaaataattacgtttttgagaaaatattttagcaaaagagtttcatgaagctgttttgctaaatgtaattcactcatttgctaaatgacggcggttaataaacctacttaattaaggaattgcgagaatgaaaaaaagcaagaaagcatgactgattggcatcgtgctgacattgtggctcgtcttaaaaaggcaggctggtctgtgagagcgttatctatcgaggctaatttagcaccaaatacattagggaaagctttagatgctccttatctgaaaggcgaaagaatcattgcagcagcgattggagtacccgcagaagaaatctggccatctcgttttgagaaacgaaaccataagccaaccttcccaagatctataaatagataactgttttgctaaatagttccaaaagagtaccgcatttaagcaaaaatagaaagcggaaaaaatgaaaatatctgcatctgatattgcgaaattaggaattccgagcctaccaactgatagacaagggattgaataccatgccaagaaaaataattggcaacactgttttgagcaaaaaggaagaggccgtcctaaaaaactgtatgaaatcgcttccctccctgccgaaatccgagcagccatcatgaaacggcagtcggacgagctggcggagaagatgccgaaaatgctgcccaaagtcagaccggggacggcgatgtcggctcaagcactggctgaagcggccaagctgttgaacgagaaacaacggtcggtggcggatgcgcgatgtgcggtggtagcggcggtattggggattaaatacgaatacgattgctctgccaaggctgcggtggctcagtttttgggcttgctggcagaaggtaaattggacgcggtcacgcttgggaacttggaaaaggccaatgaccgcagccggacggcgaaggtcggcgaacgtactttagacggctggatttctgcttatttgaaagcggaaaacgcgacggagcggttggttgctttggctccgaagacgacgaaggcggtcaagccgattgaaagttacggatggttgccgatgtttatgcagtttcacaatattccgtccgcgccaaagctggcgcacagctaccgctggtttgtgcagtgggcggaagcggaaaatatgccggtcaatgatgtgcctaacttgagtatggtgcggcgcgtttgggaaaagctcccgttgattatgcaggagcgcggcaggaaaacgggggcggcttataaatcgctgctgccttatgtgaaacgtgattggggggctttgaagccgaacgatgtttggatcggcgacggccatagctttaaggcaaaggtggcgcatccggtacatggcagaccatttaagccggaagtgacggtgattattgatggttgtacgcggtttgtggtcgggttttcggtctctcttgctgaaagttgtgtggcggtatcggacgctatgcgtatcggggtcaagcattttggtttgccgattatctattactcggataacggcggcggccaaaccggcaagacgatagaccatgaaatcacgggtattacgtcccgaccgggtatccgccatgaaacgggtatcgcgggcaacccgcaagggcgcggcatcattgagcgatggtggaaagacaatctgattgagatggcgcgccagtatgagacgtttgcgggtgcagggatggacagcagcacgaagaacctgatgtaccgcaagatggaaagtgcgtttaacgctttggaaaaaggcaaggatttgacggaggaacaacagaaatatttgaaaaaactgccgagctggtcgcgttttatagcggatgtggtcaagtgtatcgacgaatacaacaaccgcccgcacggcgagctgccccgacatcctgacggcgggcattatacgcctaaggcttatcgggaaatgaggctggaacaggacggtatcgcgccggatatgttgtcggcgcaagagctggcgacgatgtttatgccgcaagaggtgcgaaaggtacagcgcggttggctggatttgtttaacaactcttatttctcaaccgagctggcggagtatcacaaagacgaggtacgggtcagctacgatttgagcgatgcgtcggcggtcaatgtgtttgatatggacggcaagtttattactaaggcgcaggccaacggcaatacccgcgaggctttcccgacggctcgtatcgaccaactggcggaaaaacgtcgaaaaggcaaaataaagcgggcggaaaatgcaatcaagctcgcaaacgcggaagtcaatcctgctctggaacaggctgcggtttgggacgagctgggacatttgggcggaaacgacatcgaggcggagtatgcggtattgccgaaaacgggcacagacgattttgtgttgtttgaggcggatagataaaggaaaacatgatggacaaacagcaaaatgcagcgttttcggccgagcttgttgaaaaattgaaactcaagcgagctcttgggcggattcaacgagctcaagcaaagattcaaggtgttcccgctgaacggaatcaggctcaaacgtttttgcctgcgcttgaaggaaactgcgaacctgctcaatcgaagtcggctcttgacgggtaatccgctggagcagccaggaaagtacgaaagaatcggcaagtgacctgtcttccaagtcttgaacggcgacttccagcatgatcaggcgtttttctaaatcgggaaactctttcatttcagacggcctttaaaggttgtttaaaactcaaggatattaaaaatgaaacaaattaatcaagcattgcaacaaaaactggttgaatttaaagaaaaatcaggcatgaaccaaacccaactggcacgcggtatcggtacttcgccggcatccatcagtatgtatctgaacggcacttatgcggaaaaaggcggcaattatgaaaccatcgagccgaaaatcgaggcgtttttggagatgcaggacagtaaagcgcaacgcgaagagctggtgttgggttttgtatcgactaagacgacccgccgtattgcagaagtgatgcgcgatgcgcacgaaggcggcgaaacagtggtgatctacggtcaggcgggattgggcaagactcaggcggtcaaaaactactgcgagaaaaaccctgcggccatcttgattgaggctaatccgagctttacggctttggtcttgatgcgcaagttggcgactgcggcgaaggtatcggcgatgggcagcctgaatgatttgtttgagtctgtatctgaccgcctgcgcgattcgggccgtctgattgtggtcgatgaagcggaaaacctgcctttacgcgcccttgaaattgtacgccgtctgcacgacgagactggctgcggcttggtgttgagcggtatgccccgactggtggccaacctgcgcggtaagcatggcgaactggtacagctttacagccgcgtgtctgttgcgctgaatttgggcgaatctttgccggatgacgaactctttgagattgcgaaagcggctttgcctgatgcggtcaagcatctgctccctgatagtgtacaagcgttgattacggtcatcgggtttaatgaaacgctggagctggtgcgcctgatgggcggtacgacttatcctttgcggcagggttatacgaaaaacagtcaatcccgtgttgcatacttggaagagattatcggcagtgaggcggccggtcggctggtggaggcaatggctccgtgcaatctgtttataccccgttgcgagacggccttgtatgagttgcgaaaccgtaaaatccgcagtcagtttgaccggcagacggcaggcggtacccctgcttatgaggccgttaacgatttggccttggcacaccgcctaagcgaccgccatgtgtggcgaattttaaagcaggcggataaggaagcggagcaggagaatttgttttagaatggaatgccatgcagatgtatggcattttattttggagaaaaatatgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataaaataaacgattctaaggccgtctgaacaacaggcggcttttttgttgcctactgacactgtttcgcccgctgcaaaagccatgccgtttgaaaatgtaagcctctgaaagtgcattttaatctgattttgagggaggctttaatgagcaaaattatttgtctgactgccggacacagtaacaccgacccgggcgcagtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaaataaaaaggaaatcgaaaatgtccttactcaagaccgtaaaaatgcaagcggcggttgcattgacggctttggctctcacggcctgcagctctacaaccgcgccctcggctacggaaattaaggttgtcgaaaaggcagtcatgccgaccccgcctgctgcattgatggtcgcgccggtacgcccgaatccgccgaaagacggcaagacggccacgctgttggaacacgccgctgagtttggtggctatgtggcggagttggaaaatcaaaatcaggcttggcgcgactgggcgggcaatcactcccgcaaagtcggaaactgacaaaaaagcccgcgtagggcgcgggctgagggtgaaagcggattttatacctcttttacaggggtagcggcggtagtgcttttcagcaaatcgactgcgtgctgacagttttgcttgctggtgtagccttcgccctgagcgatgatttcatggttggctgctttcaaacgccaacggtattcgccttttgcgtctttatagatttcaaaatacataaggtttctcctatgaatgagtacacgttttcttaccgctttaacggcaagtcctggtcattgagcatttgggcggacaaccctgaagaagccagggcgaaatttcgggctgcacgagaaaatgcgcactatgacggcgaagttgtagcaaaggtttatacatttgtaaatatttcgtgggttaagaaattgtacaagcggacaaaatatttaatgggtatcaaagaatgacctaccgtgaattagttgaacgtcagttggctgtgcgccatgccgatttggaattgggcttaagccgcgcacgcgagcaagagccgtttgtcattcatgtttccgatctgttggataaggcaggcattgagtacgcggtacgcatggataaggattttcagacgacgtttcaccttgaatatccaattacgaactatgacacctttaaacgtgcggtttggcaaactttgggggcgtattactgtgtttgtaatgatggtgatggactggagattgccagcaatcgccctgacggttacgccgtccgtatcgtattcggcgatgtgccggtttaaaggggttttaaatggactttgaatttggtttcagaaccctgtggccgattgcgacggcggcattttggttttgggtcaacggcatttcaggccgcctgaaagaggcggacaagcgtatcgacgaccttaaagaggagttgcacgcggtcaagctctcttatcacaccaaggcggacgccaaggcagacagcactaatattgcggcggccttggagcgaattgaaaacaagttagaaaaagtaaacgaaaaactggacaggaaagcagacaaatcatgagcgacccgattttggatgccttggcgcgtattgaaaacaagactgatcaaacgctgaaaaatcagaaggaaatgcaggcggaaattgcgcaaattcgccaagacacgaaacgcacggccattacattcggcgcactgggcggcggcgtgattacggtcggctgggaattgcttaaagcgaaaatgggactgtaattatggctcacccgcaagaaatccgtgaaaagttacgccggctctatgtgagcggcgagcaaactttggaaacggcggccttgatgtgcgaaatcccgcagaccactgcgcgtgcgtggaaacgtgcggataaggaaaaaggcgacgactgggataagatgcgcgccgcttacactttggccggtggcggtattgaggatttgagccgtgcgatgttggccggttttatggtgcagtacaacagcacgatgacgatgctgcaggattcgagtaccgaagatttgccaccatccgaccgcgccaagctgttggccagcctggccgatgcgtttacgaaaaccgtatcggccaatgcgcgtgtgatgccggaaacgtcaaaactggcgacggctttggaattgattgagttcttgatggcgtttgtacaagaaaaacatcccaaacatttgcctgcctttgtggaggtattggagccgtttggggtggaagtggagaagaagtttggttagaggccaacaaatttttttaaaagagtaatgagggtggcggcagggatagcattaattgcattttccgtaagcgtacttaatgcagtgtccttgattttccctaattcttttttcaaccagcttttttctgaatcagaaatctctgcttggtctatttttgccgcaattaaagcctgaatagtgtcgctgtgtagtttgactgtgacaacaccaagaatggcggataggccgccatcatcggtaaggaagtctatgcccttatgattaattttgcagtcaaaatttttatgaagtgaatctatcgaagtaatttcaattaaaccagattcttctaagtaataaatattttttaaaaaatattggaattcatctgattgtaaagttgctaggtgttgactttgaatttcacaaccaagagtcaaagccaagcccaatccttgtttatcaacagggatgttagaagtaataggtaaagaactactagggaaaagagagttatacaccttggttgcttttaggcagttcgggtaattatcacttaaaactcgtaagattttttcctgaatacctctatttaaccagttcataaattattcctcatgaaaacaaaagaattcctcaaatcccttgccgaactggccgccagtttgcgccaagtcatcgaagcggaagtggacggcttcgatgcgtcgcccaaggctattgctgcacgccgtgccaaggtgtttgacccggtaggcggttacgagtatttcgtgaatacctacttcccccattatatccgctcgcctgagaaatccgaactgcatgcgtttttattcagccgtctgccggagattatccgctcccccaaaggggaaaatgaggcggtgggtgcgccgcgtggagagggtaagtcgacgaaggttactcagttgtttacgctgtggtgtattgtgaccggccaaaaacattatgctgttattgtgatggacagtatcgaccaggcatatccgatgctggaagccatcaaggcggaacttgaatttaacccgcgcttgaaaaccgactttccggaagtatgcgggcagggccgtgtatggcaggccggtacgattgtgacggccaatgacgttaaagtccaagtggccggtagcggtaaaaagctgcgcggtttgcgtcacggcccttaccgtcctgacttaactgttttggacgatattgagaatgacgagcaagtccgcaaccccgaacagcgcgacaagctcaatgcgtggctgactaagaccgtattgcctctgggcggtgtcggtcagaaatacgatgtgatttatatcggcacgattttgcattacgacagcgtacttaaccgcactttgaataacccgttttggcacggtattaagtttaaggcgatgaaacgctggcctgaccgcatggatttgtgggacaggtgggaggaacttttccgaaacgacggcgagacggtggccgaggcgttttatcaggcaaacaaagacgagatggagcgcggcgcggtcacttcttgggcggcgcgtggcgtactcgcgctgatgaaaatccgtgcgcgtgacggccatgcgacgtttgattcagaatatcaaaacgatccggtcagtggcgaagatgcgccgtttgccaagtcgatgaagttttggaacgacctgccgtccgatttggtgtatttcggtgcgctcgacccgtcactcggaaaggccggggcgagccgtgacccgtccgcgattatcattggcggttatcaacgtgtaaccggcaaactgtatgtcgtggaggctcagattaaaaaacgtctccctgatttgattattgaggacgttattcgattgcaccgtcaatatcgttgcaaactgtggtttgttgagactgttcaatttcaggaatttctgaaagacgagctggtcaagcgcagcgcggcgcgtggaatacctgtcccagcgcgggcggtcaaaccggtatcggacaagctgttgcggatcgagactttacagcctcacatggcgaacggtttgattctgttgaatgagagccaacaaacgctgatacagcagttccgccattttccaaaggctgatcatgatgatggtcctgatgccgtgcatatgctctggtcgggggcggtggccaattgtgtgccgatagaatggcaaagccctaccgataacgattttgatgacgagataaaaagtaaatggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatagacgttgggcaaggctcgaaatcacttgcacacgctctcggacgccctaacgggcaggctgcggtatcgaggttatcaccgcttttccaacgtctgtacggaataataccatgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttctaaaaagcccctgaaaacgattaattgtgtatcgcgcggacaggttttaaaaaaatggcgggagggtttgaagcacgcctactctttgttgttttttcaaataggcaaaatgaccgtattgagagaggtacacatgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaatggacaaatcagcgattttgaccgcaatcacggcagcattccgcaaagaatttcaaacggccttggattcggatttcaagtgcaacactaaggtaccagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacaaggagtcatcatggcaaaaaccaacaacaaaccagaaaccgccgaaaccgccgccccgtcgtttgaagacatcaaagccgaattggacgccgtgcaggcagagcttgccgccgcccgaaacgatgtcgaaatgctgaccacagccttggaaaaagccgaagacgacaaaaaggcactgtccgccgaacttgccgaactcaaagtgcagcatacgcaacgtgccgccgacgctttggcggacagccgcgatgtgatgctcgtcagtaccggcgcagacggcaaagaattttggcgcggcggcctgctgtttgacggcggctggcgcgaagtgaagcgcgccgaagtcggcgaagcggtgtggaaggcaatctgcgccgagcctatgctgcaacgcaaggcggtcgagtaatggcatacgcgacggttgaggatatggttgcgcgtttcggtgagctggaagtcttgcagctcaccgaccgcaacaacgaggggctgattgaccgcgaggtcgcacaaaccgcgctggtggacgccactgccgaaatcgacgcgtatctggggcggttcagacgaccttttgaggatctgccgcccatcttggtgcgcctttgctgcgacattgcccgctaccgtctgacggcggctcagggcgtgttgattaccgacgaaatccgcaaccgctacaaaatcgacgtgctcgacctgctgcgtgctatggccaaaggcgaagtgcagctgggcgtggatgatagcggcgaagaagtggccgcgggcgaagacggtattgtgtttgtaaacggtaaaaataaggtgttcgggcgtgatcactgatattgagcaagcgataacagaccgtctgaaacggggcttgggtcgcatggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatgagcaaaatcaaagtaacggcggcagatggcctgcgtgtgccgaccgaacacaacccgcacgaatatatcggccaagagccggtggaggtggacggcaacagcctgtattaccgccgcatgattgatgacggcgatttggtggtggttgaggatgccgccccaaataccaaaacccgcaatactaagggagagtaatgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaacccttttcagacggcgtttaaaacaggtttaaaggccgtctgaaaccttaaaaaaggataaagcatgagcgacgctacctatgccgacgcggtgattatggagatgaacggccgcgatatcgagattgtgagcatcaagccgcaaaccactacaggccgcaagccggtcaaaacgatgaaccgcaacggccgagtcaacggttattgtgacggcgtaaccgaacacaaattaagcgttaccgccgccattccgatcgacggtacggaaatcgactgggacaacatcaccaaggcgaaaatcacgatttaccccatcaacgacgaagatcgccgcacttcctacctcgactgctttaccgtcgataccggcgagcaatatgaagtcgataacgaggcacgcatcgacattgagatgattgctttgcacaaaatcaaggagtaatgcgtgattaccgtcaaactgacccacgggctgacctacaatggcaaagtcgtatctgaattacgcctcaagccactgaccgtcggcggcgaactggcggcgttcgccctgattgatgacttgcccgagctgcccgaaaacgccacaaaagccgaactgctgcaacgcgacgtcctagagacgctgacctactggtcgcagcagattgaagcccaaggtatcccatccgacatcctgacggcgcagtggctgatggaaaacctctctaccgaagactaccataccgtgatggcggctcaggaggatttgcgcctaaaaccgtccgccgctacggcgagccccgatgcgccgtcggcggcggagcagtaaaacgcagctacctgacggcacacaaaagctaccgtcaggcggtcatcctgatggcaaggcggggataggggcggacgcagtgcgcgatatgtgccacgccgagctgtcggcatggtttgaagacatcctgtcgagcctgggcataaaaacgccgaaggaagagggagtgattgtgtcgaaacggctgagaaagccggagggaaaataaaaaggtcgtctgagtttcagacgaccttttttttatttgacggttagggttgttttctgccgattattgcaatggtgtttgtttctttttcaaaaacaacgctatataaaataccatctgccggaacgtctttttgcgctgttgctcctgtctgattggattctttgacgacttcggttaaagctgtaaaaagttgttttcctgcttccgattcgcccaatttgtctgtggtagttaaagacagaactgcctgaatactgtgtaatccatttatggcattattgactagattttgtcctttctctccgtcggtttttaaaatgtagcctactgagatagctctaattttttgctgctcgtccagtttgagcgcaatcgccccaaaatccattaccaaagtaaggtcataaccacaatcggtcttgacaatatttttattatggatttttgttgagacgttctgagttttaaatgcttgctccaaattgatgagatattgttcaactgtgatgtccattggggcggtacaatcagcagcctggatactttggacaggttcttcggcttgtgccgtttttgattgttggttgcaggctgataaaacaattgaaacacaaattgcggaaatcaattttttcatattcataaaatatccctttgaataaaatggttatcattctagtattataacgcaacaaacaaataaagcacgaaaacggggttgaagcccataccgcctcccttaaacagcctttaaacgataattgaccttgagttaatacgtttaaaggctgctttttatggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataatgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatagacaagcagacctttggcagccttcgggctgctttttttgtgcgtgtgggattgaagcccgtgtactccgtgaggccgtctgaaaacggcaaaatgccaacatggacaaagagctaaaccccagcatcggcgactataccggccgcaccgtcgatacgctgcaaaatgccgtgtatatccgcttgatgacaccgttgggcagctggtgggcggataaaacgctcggctcgctgctgcatttgttgcagcgcgaaaaagacctgcaacgggtcagcctgttggccgagcaatatgccgatgaggcactgcaaccgattgttaagagcgggcgtgccgacaagattaccgtgcgcgcagagcagccgcacgacggccgcctgatcctgcatatccggatggatacggcggcgggcgggtttgattaccgccacgaagtgcccgtgatttaaagaggttttaaacgtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaaaggacgatttatgcaccccatcgaaacccccgataagaccttccacgacggcgacggcgtgtccgaattgggcaccatcctgcccgcgtggtggctcaaccaagtgcaatccgagctgctggccgtgctgactgcggccggtatccagccggataagtcgcagcctaatcaattactggcagcactaaataggctggctgtagttatcaccggcgaccaaaccgtcaacggccaaaaaacctttaccgcccaaacccaattccaaagcggcatccatttatccgccaaccagacgaactggaacggcggccacaaagcctacatcggcgcggatgccgacaacgcccacatcgtcttcggcgacgacaccctccgcctgcacggcgcaaacaaccgcatttcctacaacaaccacgacatcttccacaaagccaacaaaccgcgttttgccgaagacatccaaggcaaaccgaacacactgtccggatacggcatcggcaatttcaaagtcgaaacattccggggcgatttgaacaccctcaaaacagacggcatctattccctgccgacggcggtcggcagctccaacctgcccgttgaaaacaccgcctgccatatccaagtcatcgccggcacgaaacacggctggtgcaggcagttgggttatcccgcctacacgtccgacgtgtacgaacgccaccaaacgagcagcgcaaacgacaactggtccgcatggaaaaaactcaattcggacggcatccccgtcggcgcgatcgtatcctttcccaaagccgtacaaaaccccgcaggctatctcaaagccaacggcacgacctttgcacaaaacaccttccccgacctttaccgcgccttgggcaacagcaaccgcctgcccgatttaagccgtaccgacatcggcatcaccgcgtggtttccgtccgaccaaatcccgaccggctggctggcgtttgacgacatccgcacgcgcgtaaccgaaaccgcttatcccgagctgtaccgtctgctgaccggaaaatacggcagcatccaaaacgtcccgcaggcggaagaccgctttatccgcaacgcgggcaacagcttggcagtcggaacgaagcaggaagacgaaatcaaacggcacgtccacaaagtattttcacactggacaaaccacacagacgcggcagccctcggttacgaagaccgcaacgaaaggcagagaagcgcgctcgtatcgacttggacggacgaaaatttaaacgacaacggctttttaaccccgcgctcggacagcaaaatggcgacaggcggcgacgaaaaccgccccaaagccctggttttaaaactgtgcatcaaagccgccgacaccttgggcgaagccgtgttttggataaagtcccacggcgaaaccatcaacgcaggcgcgctggacgcgggcacgctggcgcaaggtttgcaagacaaagccgaccgagaccacacccacaccgccgcccaaatccaagggctggacgaaaaaatcagcaccgccgttgccgcgcaattcacacgccaaaccatcggcggcgtggatattgtcagattccccgacggcacaatgatacagaccggcagctacaggttcacacgaagcggcggccccatcgaaaacgaagtcgtcttccccgtcgcctttgccgacggcaacgtcaaatgcttcgtatccgaacgccattcggaacgcgttaccggcgatcgaaggcaacacaactggctgtttatccgcgcaaaaaaccacgccgccgccattatcaccaactggtacgaaggcagttgcgactggatggccatcggcaaagccgcctcgggaaacgccgccagctccccgataggccccgaaatacctgaaaccaacgaagaaccgcaaagagagagtggaagaacatcaaccggaccccgaaaccgccgccgccgagacggcttgctcgaggcactgcaagactagcgggctgtagagatggctgtagagacgggctgtagagatggctgtagagacgggttgtagagacgggttgtagagacgggttgtagagatgggttgtagagatggctgtagagatggctgtagagatggctgtagagatggctgtagagatgggctgtagagatgggttgtagagatgggctgtagagatgggctgtagagatgggctgtagagatgggctgtagagatgggctgtagagatgggctgtagagatgggctgtagagatgggctgtagagatgggctgtagagatggctgtagagatggctgtagagatggctgtagagatgggttgtagagatgggttgtagagacgagttgtagagatgggcttcagcccgccgatccaagcaatccgaccgaaaccggccgcgccgccaatcccccgaaacctatgccccgccaatcctgccactcttcgtcattcccgccgctttcgtcattcccgcgaaagcgggaatccagaccccccgacgcaacaggaatctatcggaaaaaccgaaacccccgccaccgtcactcccgcgaaagcgggaatccagcccccaaacgcggcaggaatctatcagaaaaaacagaaacccccgccgccgtcattcccgcgcaggcgggaatccagaccccaaacgcggcaggaatctatcggaaaaaacagaaatccccgccgccgtcattcccgcgcaggcgggaatccagaccccaaacgcggcaggaatctatcggaaaaaaccgaccccccgccaccgtcattcccgcgcaggcgggaatccagaccccaaacgcggcaggaatctatcggaaacggctgaaaccgaacggactggattcccgcctgcgcgggaatgacggcggcaggggtttcgggattcccgccttcgcgggaatgacggaaagtggcgggaataacgaaaggcgggaatgaccgcgcaaaaagccgctgcccccttcggacggcaccggcaacaaaaaaccgcacggccgaaaccgcgcgggaaaggatagtcgggcgcgcccgataagcagcggccgcccccgttatttcaattgggcgatatattggcgcaaaacctcgttgatgcgcgtctgccagcccttgccgccggcgcggaatttttcgaccacatcggcggacaggcgtatggtaacgagttgtttcggggttttgcctgtgtttcgtttttgcattacgcccttttcttccaattgtttttgatgggaaaaaagcacctgtgccaagtcttcgggcagggcttcggcaatggggcgggcaagcgcaaaatcttcggcggcaagttcccgcacttcgccgtcagcgtttgttaaggattgacgttgcatattttttaacctctcttttattcgctttgcgaaaactgatgacacggatgccgtcttttatcggcgtaaaacagacaatgtgcaggcgttgcgtatcgcctagataagcagcggcaacataacgcggttcggggtaatcaaagcggacatcgggcacaataacggccgttgtccagcgtatttgcccgactgattcaaagggcaaattccgctcttcgatattgcgttgatttttttcggagtcaaattcaatcttcattgcagcttgcagcgtattttgtcgttacattataagcggcaaaaaaccaaaatgtaaatacaaaaaaggaaaccccaaaatgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctgaaaaaatacgtttaccacctgttggtagccatcgaccaactgttcaacgccctaaccggcggcgcggcggacgaaaccctctcaagccgcacctatcgccgcgcgcggctcgcccaaaagcccaaaacccgctggaagattttatataccctgatcaacggcgtgtttttcgaccgccaccactgccggcaggcgtatatcagcgaactgaaaggcaggcagcacgacgcgcggttcaaccaaagccgcgccgccggggaaaaggggacgcgatgaactacttcggcatggtagagtttctgcgcctgatggcaatggtgcggccgccatttgtcttcttctccggcacccgcagcgaactgcctgcttatcttgacctcgtggcagaactgcgcctgaccggatgggagcgttttgcaggcagccaaaccttgactgtgagcagcacatcaacagcaattcaagctacgacgaccacctgatttataagttctgaccgcaagtagcgtactacttttaaaggcataagataatccccgtttaacagaccattaaacggggataaatttgtgcaaaagctaatacaatttcctacgcttcggcggtgcaaaagctgccgccaattcgtgcaaaagctgccgccgccttacattccagtgcaatgccgtctgaaacttcgctaatctcgggttgccgcgcgctgtgttgttcttcggtactcagcaaaaagccgtacagacgctccaatcgggcgcggtaggcggtgaatttgttgtagaacatccggaagaaagaaagcgcgttttgcagtcgcgcgaaggcttggacggtctgctggatgtcgccgattttgatttgtccggcaaacaggcgcggcgcttgcaaaataatggggaagagcttgatgccgttggtgaacatatcattaaagccgctcaggcagacgctttgtcgcgcaatacgccagcggttgcggataatggctttaaaacggtcagaaagctggtcgtgttcgtgtttttcgccgctgtaaaacgccacgctttcggcgtggtcgcgcacgcggatgagggaataacggtagtcgccgttgagtttttcgttttcataattgtaacgaatcaaagggttgcctatccacatggcgataaaggtcgccaaaatcacaaatatatagacaaaccaaacgatgccgtgcggaatgtcgaagccgaacacggtcaggatgccagccaagccccgcaaaacaacggcaaattccagagaagtaacgaccgaattgaccatgccgcgcacaaattcgatggtcgaagcgataaattcctgcgcgtcctgttggatacgctggtcgatgttgtccggcgcgtggcggcgcatttgcaggcggtagtagtttttgtcggcaagccagcgtgctgtcagcacttcgttgagccgctccgaccatttaatcgccaagccttgatcgaggaagtcgttgacgacgttgttaaacgcccgtatcagcaccacgcccgcgttcattgcagcaaacatccaaaatgccgaagcatttcaaatcctgcatcgagtcgtaaagccctttggacataaaggtactcaacacattcagccgcatttcggttaacaccagcgtaatcatcgccgtaatcagcagcaagactttgaccgcgcttttcggtgtcagacaaagccaaagcggtgtggaataaagctcggtttgccatttctgcatgggaaatttcttacggtatcaatgccgtctgaaaaagacgggtacagttgattttttgatgaagtttggggaagttttgccggtcagggtacattgcgtgttaatttatagtggattaaatttaaaccagtacagcgttgcttcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgctatttaggtgacgcgttagaatactcaagctatgcatcaagcttggtaccgagctcggatccactagtaacggccgccagtgtgctggaattcgcccttccgggctggatgtgttcgggaataccgtttttcagatagccgcgtatgcctgcccagccttggacgaaacgggaaaaacgggcggtatcgctgccccaaatgccccagcagaggcgaaatacgagcaggaaaaggacgaacagcccgacgcgcgtgtgccattgcagcatatcgccgccggctttcgcgctataccacataaagggcagggacgcggcaagcagccagtggaaaaggcgggtggggaggtcccagactttggttttgtttttcataatcggtttccggcggtagaatcggtttgttttcgagccttattttaaccgattggaggggcaatgtttcccgtttttcatctttcaggcgagagccgccgccagatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggcaaagtgtgggcgggtttcaatcaggatacgctaccttttgccgttattgccggttttcccgagattatgctggatacggcggacagtttggccaaacgtcaagatataaacgcctgggttgtcggttgtggattgggtacaggtagggcggcggtcggaacgcttgccggaattttgacggaacacacggacaagcccgtcgttttggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcggcattcatttttttgttgccggcttccacaaagtatttttccatcttttcggtctgcttgcccaacgaagtgtcgtcgtttttcaaaccttcatagacggtatcgggatagccgccgtaataatacagggatttttgcccgttgccgccgcaggcggtcagagccaagaccgccgcacacagcgacaaacggctcaaggttttcggattcatcatttctccttaacggttgggttgccatgcgccgttgtcaacagcctgaaccaggctgttgacggcttcgcggattgccaagtctaaaactttgccgttcaaagtcgcatcgtagccggaagtgccgccgaaaccgatgatttcacggttggaaagtgcgtattcgcccgcgccctgtgcggaatagacgatttcggaagtattgacgttgacgatattcagagccacttttgcataggcgatttgcgatttgccgcgacccaaaatgccgaagagctgatgatcgccgacatctctgcgtccgaattcggttacatcgccggtaacgacataatctgcgcctttcaggttatgcgctttgccggaaatgccggattcctgttttaatgcgttcaaattggtgcggttcagtacgttgaagcggttggtctgttgcaggtgcgttactagaatggtttttgcctggctgcccaaacggtcttccccgtcggagaaaatgcctttttggaagctggagcggttgtcgaatgttccgacggaaatcggggtacgaacaccgtgatattgcgtattgtaggaggcgactttctctacctcgagactgcgtgaggattcggtcgcacagccggtcagtgaaacggcagcggcggcaaggacaacggcggtggaaacggttttcataaaatttaccctaaggtcaagttaaggaaataacgggttgtcattattgtccttatgtaaatttaagtcaaggtgtttgtctgtgcgggacggatgcgcgcggaaggtacggatatttttcaaacggaatcgcggcgcgggcgggatgcctgccttttccggatttagaggtaaacgatttcgccactccgccctttgctttcggcacttgcccaccagacaaatgcgggcagcacgtccccgtagcttttgcgttcgcttttggcttcgcccggatgggatttgatgcgttgcggggaattgatggggccggggacgaggacgttggcgcgcaggttgccgaagcgttcccattcgtcggcggcgactttgcacaggtagttcaacgcggctttggacgcgccgaagccgccccagtaggctttgggtgtttcgccgtggctttcgccgacgaagatgacggacgcgtcgggcgactgcttcagcagcgggaacagggcgcgggtcagccccataggtgcgacggtgttgatgcggtattggttgacccattcggcgacggtttggaaatccagcggcgagagggcgtaaaaatagccggcgcagtggacgatgccgtccagtttgccttgcgtggcttcggcaatggtggcggcgaaatgttcaaattctttttcttccgcgctaataaggtcaaagcagatggcgaatggttcggggtatccggcttcgacaatcgcgtcatacactttttccagttttttctgatgacgggcaaccaaaatcacggttgcgcctgccgccgcataggctttggcgacctgttcgcccagaccttgcgatgcgccggttactaagatggttttgtcggacagtgtcgccatactttttcctttttggttgtcggttaaggtattttagcgttttgccgcaccttgtaaagcgtcccgatgtcggccggcgttttcagacggcatcgctcaggctttgcaggcaggcttccgccgacgcgaaacctgattgtacggcggcttcgagcgtggcggggtagtccgggtggaggtagtcgccggcggggaagatgcggtgccggtgcaaccacgacaagtccggcggcggggcatcggctgcggttgtggcgcgtttttcggtgatgacgcgcacggcttcgggttcgcccaaatgcggaaggatgcgtttgaggtcggcgtgggctttgtccgcccacgcccggtttgcaaacgcgccgacgcggtcggaaacgctgatgacggcggacacttcgttttcaggcagtccgagcctgccccggcaaagcagccattgcaccgtgccgtcggcaaggccggtcagcggggcgggcaggcggacgggttcggcgtagcgcagatagacggtggtgatggcgtggtagcgaaggttttgatatgccgtctgaacgtgttcgggcgtgccttcgggcaggagcgcggcggcgtggtagggcgcggtggcggggacggcggcatcgaaagcttcgccgttgacgagcactttcccgtccgggagggtgttcagacggcatacgcgcgtttcgaggcggatgtccgcgccgagccgttgaagatccgccaaggcgggttcggcgacgattgcgcccaaatcctgcttgggtaggagatagtcgctgccggattttttcgtcagcacgccgtcggacaaaacgttgcacaacacgcgcaggcttgcggtttccaaaggcgtgttgagcgcgccccaaaccaagggctgccaaaactgcatcacggcggcacgcggcacgttccgctgtttcagccattgcgccactgtcgtgtcgggctgtccgaggcgtgcggacttctgcaaatcggacatatcggcaagcagtttggctttgaatgcagtcggtgcacgccgggcaagcagcacgccgcccaaaatatgcagcggcgcgggcagggggagggcgcggaactgcaaaccgccgtgcatatgccagtgcagcggtacgcgcaaaaaggcggcacggggatccgaaccgatggttttcatcaggcgcaacacgccccggtatgcgccgagcaaaatgtgctgcccgttgtccaaaaaaccgaaaccgtcggtatttccggccagtgtgcgcgccctgccgcccgcctgccggccggcttcaaacagggtaacgtcggcgtgccgcgccaaggtgacggcggcggacagtcctgcccagcctgcgccgatgacggcgattttcgggcgcggatgcggcgtgttcatcatttattcctccaatggttttgcagccgtatctatttccgtttccgaaaatgacggtagaaaaggatacaggctaaaaataaaggcagcagaaagcgcgcatagggataccacggatggtctgcatgccagtatccgtaccgtccctgtggaacggtatcatagcggtaactgtcggggaaaaagttgatccaaaccgttactgccagccataaggctatatccctgactgctttcatttacttctgctcctgtttaaattcccagcaattccatttcaaagcgcgaacgccaacgggattgcgcggttacgatgcagactttcagacgatggttgaaaccccgtccggcggggctgtgggaatcgggtttgcctgacgggcggcgggcggtatgcgccttatgcccgttccggcgtgccggggcgcggtttgaatccgaataaccaggttttcagggcaatgcgttttttgcgcggcgaagggagggcgattttgtatttgaggacgttttgtgcgccgtctcggtcgatttcgttcaatagctcgtaataaaccgccgccatgaccagtccgactttttgggcttttttatcggcatcaggcagcagcgatacggcttcgcggtaggtttcgcgggcgcgtttgatttggaacgccatcaattcggcaaaattgcccgtcgggctgcattgcaaaatcacgcttgcgggtacgtcaaaccgccgcatttcctccatcggcaggtaaatccgccccctgcgcgcgtcttcgccgacatcgcggatgatgttggtcagttgcagcgcaagtcccatcttgtcggcgtattccagcgtttggtcgtctgaaaaccccaaaatccgcgcaatcaggcagccgaccacgcctgcgacgcggtggcaatacagtttcaattcttcaaaactgccgtaacgggcttgaaccaaatccatctgcatcccgtcgattaaggcttccagttcatatttcggcagcttgaaggtttccttaacttgccgcaaggcctgattgacggggtgttccggcatcgcgccgccgaataccttgtccaaatcgccgcgccaccagttcaatgtcgcctgtgcaacatcggggttggaacattcgtcaaccacatcgtccaattcgcggcaaaaagcatataaaaccgttaccgcatcccgtttttcctgagtcaggaaacggaagcccgacaaaaaactggagcggctttcttctgctttttggcggcaatagtcgagtcctttcacgatttatattcctaatgatgggcgggaaaggcggattttatcggcatttggcggtagagggcaatttcggcggcacgacctaatccttagcggtttgctcaactatcggcgcaaattctgttaaaatgccgctttccttcctttacacaccgcaccgacaggcagaatttatggctcttttgcagatttcagaaccgggtatgtccgccgccccgcaccggcaccgtttggcggcaggcatcgatttgggtacgaccaacagcttggtcgccaccgtccgcagcggcagtgccgcctgcctgcccgatgccgaagggcgcgttaccctgccttccgtcgtccgctatctggaaaacggcggcattgaagtcggcaaaaccgccctgtccgcccaaaaaaccgacccgctgaacaccgtcagctccgccaaacgccttatcgggcggacgcttgccgatctgcatcaaaatacgcactacctgccttaccgtttcggcgacaatcaacgcgttatcgaactgcatacgcggcagggggtgaaaacgcctgtcgaagtgtcggcggaaatcctcaaaacccttaaatcgcgcgccgaagaaaccttgggcggcgatttggtcggcgtggtgattaccgtccccgcctatttcgacgatgcccaacgccaggccaccaaagatgccgcgcgtctggcgggtttgaacgtattgcgcctgctcaacgaacccaccgccgccgcaatcgcctacgggctggacaacgcctcggaaggcacgtttgtcgtgtacgacttagggggcggcacattcgacgtatccgtattgcaactgaccaaaggactgtttgaagtcaaagccaccggcggcaacagcgcgttgggcggcgacgatttcgaccaccgcctgttctgccgcctgctcgaacaaaacggactctcccaactcaacgaacaagacagccaactcctgctctcgctcgtccgcgccgccaaagaacaattaaccacgcaaaccgaagcgcgcattcaggcgacgctttcagacggcatggcaatcgacacaagcatcagtcgcgccgagttccacaacctgacgcagcatttggtgatgaaaacgctcgaaccggtcacacaggcgttgaaagatgccggtgtcggtaaaaacgaagtcaaaggcgtgattatggtcggcggttcgacccgtatgctgcacgtccaacaggcagtcgccaccttcttcggacaaaccccgctgaacaacctcaaccccgacgaagtcgtcgcgctcggcgccgccatacaggcaaacgtcctcgcaggcaacaaaaccgacggcgaatggctgctgctggacgttacgcccttgtcgctcggtttggaaacctacggcggcttggcggaaaaaatcatcccgcgcaattccaccatccccaccgcgcgcgcgcaggactttaccaccttcaaagacggtcagaccgcgatgacgatacacgtcgtacaaggcgaacgcgaactggttgccgactgccgcagccttgccaaattcaccctgcgcggcattccgcctatggcggcgggtgcggcgcgtatccgcgtaaccttccaaatcgatgcggatgggctgctgtccgtttccgcccaagaacaaagcaccggcgtacaggcgcaaatcgaagtcaaaccctcctacggcttggacgacgacaccatcacccaaatgctcaaagacagcatgagcaatgccgccgaagatatggcggcacgcgcccgtgccgaagccgtagtcgaagccgaaagcctgaccgatgccgtcaacgccgccctcgagttggacagcgatttgctggatgccgaagaattgcaacagattcggcaaggcatcgccgatttgcaaggccgtctgaaagacggaaaagccgaagacatccgtgccgccgccgccaaactcggcagcatcaccgacaatttcgccgccaaacgcatgaaccgcaacatccaacgcgcgctgacaggccagagtgtcgataatatttgatacttaaacggtttcagacggcatagaaataatccgatgccgtctgaaggctcgaaaacacttgaaaaacatcgatatggaaaagtcaggcattgtctatctgatgaaaaccgtcatcaagggcgtgtataaaatcggcatttcggatgtaagcaattttgaaggcagaatgcgccatttggaaaacaacggttatgcgaacgttgccggattggaacgcatcctcgccgtcaaaaccgacaattacaaagaaaaagaaaacctgctccatgaaattttcagcaaaagcaggataggcgataccgaattgttcgccgtggacgaaaaccttgtgaaacgtttgtttttatcgcttcgcggcgaaatcgtgttcccgaaaaacgaaacggcggaatcggaatttgaaaaaagcgtccacgaacgcaggcaggaagggaatgccgggtcaggccgcaaacaactgcttgatttggtacggcgcggacaccgggaatacccttacgcgctgccccggcttttggcgggcgcggcattctacaagccgaaaaaatcgaaaatccgcctttttaaagaagcatatttcggcaaaagcggcacgaggctgaccgacgaaattgcagacggcatccatatttacacctgtttttcgcgggcggatttggaaaaagcctattccgaatatttggaacttttcaaatccgaatcggatgccgaaggcagaaagccgcagtaaggtgcaaacagataccgtacacgttgaggagcagatatgatgggcgattccgtcatttattatgtagaacaggcagacgaaccggtaaaccgtgccgacgaacgcgcccgtaaaacattcaaatatttttggcgcgagcttttttgggaacgccgccgcattatttccgccttggattttgccatggtcaaagtcccttttttccaagacggcgaagacggcgaaatttgcgaacatatgtggatcgacgatatttattttgacggtctttatatttacggtgtgctgaacaatgaacccggcgaactgaccaatgtcgaacaaggcgaaagcgtttgcgttccggttgacgacatcagcgactggatgttcgtgtgcaacggcatcccctacggcggctttaccatacaggcaatgcgcgggcagatgacggaagaggagcgcaccgaacacgatgccgcatggggaatcgatttcggcgatcccgggcagatattgctggtgtatgaagaaaaagaacatcccgaaaatctggaagagcatccgatgtgccggaactgtattgacgattttcggcaacagttgtcccaaaactcggattatctgcgggaacaggacgaagacggctatacgccgcttcatcatgaagccatcgcaggaaatgcacttatggttcaagccatgcttgaatacggcgcaaatcctgcctcaacgacatcggaaggctataccgccctcgattttgcctgcctgacgggctggcaaaatgttgccgacctgctcgaaccgcgacattaggcagacagttttccgaaaacgaacacaaacactttttacagaaagacaataaaaatgcccaaaatcaccgtacttccacacacgacattatgccccgagggtgcagtcatcgataacgcacccgaaggtaaaaccgtccttgacgtgctgctcgaccatgatatcgaagtcgatcacgcctgcgaaaaatcctgcgcctgcacaacctgccacgtgattatccgcaaaggtttcgacagcctagaagagccgaccgaattggaagaagacctgctcgatcaggcttggggtttggaagccgattcgcgcctgagttgtcaggcggttgtcgccggcgaggatttgattgtggaaatccccaaatacaccatcaaccacgcgcgcgaagaacactgaaaacaggccgtctgaagccggcacgcttcagacggcattgttgcgcggataaggcgcaatcgcccgaaaacaggcgttcgtacaggcggaactttcgattctatagtgaattaacaaaaatcaggacaaggcggcgagccgcagacagtacagatagtacggcaaggcgaggtaacgctgtaccggtttaaatttaattcactatatattgatttttatcggttttctgacggaataatccagtgcggcatccgaggcggattactcggacgcgatgcaccggtatttatcggttttgcagccggaaaaaccgccggcgggttatagtggattaaatttaaaccagtacagcgttgcctcgccttgccgtactatctgtactgtctgcggctcgccgccttgtcctgatttttgttaatccactatacttttagggcgacggtcgggcagtatgccggatagcgttccactctcgcttctatattgattttgattggttttctgacggaatgacccgatgcggcatccgggacggcttgtgttttttcctgcccgcctgccggattttcccatccttgcgtgaaaccgaaagagacggcggcgcggcggacaagctcgagatagcgtccttcaagctccggacaggcggcggacacgctttctaccgtaaccgtgaaaccgccgcccgacccggcaaggcgttccgcaatttgcgtgtagatgagccaacgttgggcgcgcaacattgccgaatcgcaaccggcagccgctttatccaaggcaatcaggtcgcgccggttttggtggtgaaggcaaaccgttactctggagaggatatgttgcccgtccaatatttgatacagtttgcgtatcagcagaatcaggcggtcaaactcctccatctccgacagggaatcaggatggtcggaagcggtataaaccagtttggacaattttgcggcaaacatattgttcatcaatcttccttgtcggttgaaaccccgctcttcggggcggtagaatcagatttgtttgggagggacaactcctcccagatcaggacgacacataggctggtgcttgatgtgttgtccggcgagttgaaacattcagcaatcctcaaggggcggcagttttgccgaaacatattctacacggcttcaatgccggacgataaaaggaaattcatatgaaatggaccgacacccagcgcatcgccgaagaactctatgacctgcacggcgaaaccatcgatcccagaaccgtgcgctttacccaactgcgcgacctgattatggcattgcccgaatttgacgacgaccccgcccgttgcggcgaacgcatcctcgaagccgtgcagcaggcatggatagacgaggcggaataagtttcgggaatgccgtctgaaatgcggcggtacgcggttcgtgcttctgtttgcagcgggaatggttttaccagtctccttttttcagcctgtccagttggcggcggtcgcgcttggtcggtctgccgtcgggataggcggaagtgatgcggctgaattggtcgagctgtttgcgctcttccctcaatgttgccgttttcgcgtcctcttcatacagaagccgcgcctcggatgccgggcggcgttggtggttcaaacctttaaccttgattttatagggaagggaattgagcgtcaggtcgataatatcgccgatgtctatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataagatacgccgccttataactagtatatatgcactaatccactgttttccatgctgtccgaacacaaaaagagggtatggaaaagccgttttggacaataaattaactgcggaatatgcacaaatagcgtatgatagcggcagaatctgttgatgagagcttcattctatgaaacctgtttttttggattttgaacaacccatagccgaactgaccaacaaaatcgatgagctgcgtttcgtccaagacgagtctgccgtcgatatttcggacgaaatacaccgtttgcagaaaaaaagcaacgacctgaccaaatcgattttcagcaaactcacacccgcccaaatttcacaggtttcccggcatccgcagcgtccctatactttggattacattgaggcactgtttaccgattttgaagaactgcacggcgaccgccactttgccgacgattatgcgattgtcggcggattggcgcgtttcaacggacaaagcgtgatggtcgtcgggcatcagaaagggcgcgacaccaaagaaaaaatccgccgcaacttcggtatgccccgtcctgaaggctaccgcaaagccctgcgcctgatgaagacggcagaaaaattcggcttgcccgtaatgacctttatcgatacgccgggcgcgtatcccggcatcggcgcggaagaacgcgggcagtcggaagccatcggcaaaaacctgtacgaactgacgcgcctgcgcgttcctgttttgtgtaccgtcatcggcgaaggcggttcaggcggtgcgttggcggtcgccctaggcgattacgtcaatatgctgcaatactcgacctattctgttatctcccccgaaggctgcgcgtctattttgtggaaaaccgccgaaaaggcggcggatgcggctcaggctttgggcattactgctgaccgcctgcaaaagctggacttggtcgataccgtcatcaaagaaccattgggcggcgcgcatcgggatttcgggcaaaccatgaaaaacgtaaaagccgttttggaaaaacaactgcacgaagcgcaaagcatcccgcttgccgatttgctttcgcgccgtttcgaccgcattatggcttacggcaaattttcggaacaataattcaggtagaacaagcagcaagcagtttgtctgaaactgcttgctttttctttatcgggacggaaccgtgctgactttagatgcgtttgagcaatgcttgaaggattgttttcctcaaggtctgaatggaaaaaaaacagcggtggcattaagcggcggcttggattccgtcgttttgctgcatctgcttgtccgcgccggaaaaaagggcggttttattccggatgcattgcatatccatcacggcttgagtccccgtgccgacgattgggcagatttctgccaaaactattgcgatatgctcggggtggggctggaaacggttaaggtctgcgtggaaaaaaacggtttgggcatcgaggcggcggcaaggcaaaagcgttatgccgcgtttgccgaaaaaggctttgacgttttggcgttggcgcaccacagggacgatcaaatcgaaacctttatgctggcggtcgcgcgcggcggcggtttgcgcgctttggcggctatgcccgccgtccgcccttttggggaaaaaggcatcatctggcggcccttgctgcctttttcacgccaagatatatgggattatgcccaaaaacacggtttgccgaatatcgaggatgaaagcaataccgatacggcttatttgcgaaaccgcttccggcaccgtattttgcccgaactttcggcgcagattccccatttcgggcggcatgtgctgaacaatgtccgcgctttgcaggaagatttggctttgttggacgaggtcgtcgttcaggactgccgttgggtttgcggggccggttatttcgatacggcgcggtggctgacgttttccccgcgccggaaaacccatattttgcggcattttctgaaggaaaacggcattcccgtgccgaatcagaatgcccttgccgacattgcccgggttttgacggaggcaaaaaccggacgttggaacttgcaaggctttgaattgcatcattatgcaggcaggctgtttgtgttccgactggaaaaaacggataaactgcggtttttgaaagacaggcagataagcggaaatttaagggaaatattgacggggcagggatttgtgttgaagcggcatccgtttgggcttcctgagcatcttttggagcaggacggaattttgaggacggtagcggcatcggatacgttggccatgggcggcatccataaggatgtgaaaaaaatccttcaggggaaacgggttttgcctgtcctgcgcccaatttggccgcttgttgccgacagcggaaaccgtccattggcgttggcaaactgttgtgcggatttccaatactcggtttcagacggcattttgcccgtccatcctgactttcccattttattttgataatatcgcaaacagatttcggcggcgttcagtcgggtattgtccggttgcatatttctaaaaggcttgtgaagtgaaacacatcagttcgaccaataatgaacacatcagacacctgcaccgcctgttgtcgcaaggaaagttcagacggcaatacgcccaaaccgttttggagggcgtgcacctgcttcaggttttcctgcaatccggcgggatgccggtcggggtatatattcccgaagcgaaaatgccgtctgaagaagtccgtaaattgacggcggttttgccggaagacgggtttttttccgtttcagacggcatattgaagaaaatcagcagcctgacttgtgcggatgatgtgcttgcgctgattgatattccagatgcgggtgctttgccggccggcggcgattgcgtggttttggacggcgtgcaagacccgggcaatgtcggcacggtgttgcgaagcgcggcggcggcgggaatcggcgcggtcattttgggcaaaggttgtgcggacgcgtggtcgcccaaagtgctgcgagccggaatgggcgcgcatttcttgtcggagatttatccgcaggcggatttggaaatatggttggtgcgctataaaggccgtgtgtttgccaccgccttgcgcgaggaaaagcaggcggttttgtacggcgaagatttgtgcgaaccgacagcctgggtgtttggcaacgaaggcgcgggggtcggtaaagcagttttagatagggcggacaagtgtgtcaggataccgatgcacgatgcaaccgagtctttaaatgtcgcgatggcggcgacaatctgcctgtttgaacaaatgcgccaacgggcggcgtattgaggaagagaaatgccgtctgaaaaaatctattacggcgtattgattttcttatgtatcgcttctatgctgctgtcgccgtttttttatgcgggtgctttgaagcccaagaaggcggcattgcggaaggacgggcagtggaaactcatctgattgtccaatgccgtggcggcggcggttttggcttgggtgtggtggaaatggttttgacagatattgctcaaaatcgtgctaatggaatccgaacaaataaagaatttggtaaaaaatttgttaaatcaacgaattaaagttttgtggaaaacaaaacagctctaagcaaatagggcgtttgtcggtaaatacggaagagttgcggcattatcgggcatctttaacaagtagtgccgtcttgacaggcaatcggtttttatgggcagcttgcaaaatcgcggatataaaattgcgaatcggttaaagtgtggggacgctatgaaaaattgcgaattttttatgacccgacaagggcaatctatgatagcggtgcagattacttaactagggaaaaacatagattagtcgtaattgcaaatagtgcttgggggctattgcttaatttatcttgttattatgacgaggttttggaaaagcggaaaataccgttcggcaaacaggaaattgatgacgatatggacaaagtgtccgcccttaagcggaagtttaaagatatttctgaaatcaaagtaggggatggttgggaatacccgttcaattatgagcagggaatgaaagaattagatgaagtgctattgaaatacattcccttttttgaagaagaacgataaaggaggttgatatgcgcgtatctaaaataattggaagtatgttgcttgttacagcggttcagaccgtattttcggcaaatgtttacgcgtgccgccataatggtaaaaccagttacagccaaactccgggaaaacattgtaccaacgcgggtttggggcgggaccgggtgtacagttcggttagaccggcagtaaaagacagggcggaagacgcaggggtcggcgattattcggacacggtgagggacgaacacgtccaaaatccgaaaggaaatgcacagaaagacggttcggctgccggcatcaagccgcactgattgaagccgaatcagcccttgcgctgtcggacggcaaaatttgaacgattggggaactttgatgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggcaggccggcgaagccaatgccgacggctcgttcgacgtgttgctcgacggcaaaaccgccggacgcgtcaaatgggatttgatgggcaggcacaaccgcatgaacgcgctcgccgtcattgccgccgcgcgtcatgtcggtgtcgatattcagaccgcctgcgaagccttgggcgcgtttaaaaacgtcaaacgccggatggaaatcaaaggcacggcaaacggcatcaccgtttacgacgacttcgcccaccacccgaccgccatcgaaaccacgattcaaggtttgcgccaacgcgtcggcggcgcgcgcatcctcgccgtcctcgaaccgcgttccaacacgatgaagctgggcacgatgaagtccgccctgcctgtaagcctcaaagaagccgaccaagtgttctgctacgccggcggcgtggactgggacgtcgccgaagccctcgcgcctttgggcggcaggctgaacgtcggcaaagacttcgatgccttcgttgccgaaatcgtgaaaaacgccgaagtaggcgaccatattttggtgatgagcaacggcggtttcggcggaatacacggaaagctgctggaagctttgagatagcccgggcgatgccgtctgaaagcccttcagacggcatcgcccggctgcgcggcacaaaggcggaaaaaccgtttgccccgtattttcaaacgcgttacacttgccgccgctgttttcagccatttgattacccgcaaccgccgtcattgcgccggcggtttgcctgtcagcgtcattgcgccgctgtaaatacgaaagaacacattatgaccgtatcccccgtcgccttgcgccgtaagaccgagtgcaagcctcatcccaccgcgcgctattggaaaaaatgcgatgtcgaagccctgttcggacttcccttcctcgacctcatttaccaagccgccgaaatccaccgccaaaatttcaacccgcgcgaaatccagctttccacgctgttgtccatcaaaaccggcggttgtcccgaagactgcgcctattgtccgcaatcggcgcaccacaataccaatctgggcaaagagcagatgatggatgtggatgaaatcgtcgaaaaagccaaaatcgccaaatcgcgcggcgcaagccggttttgtatgggcgcggcgtggcgcggccctaaacccaaagacgtggagacggtttccgcaatcatcaaagccgtcaagggcttgggtatggaaacctgcggcacgttcggtatgctcgaagaaggtatggcggaagacttgaaagaggcgggcttggattattacaaccacaacctcgacaccgaccccgaccgctacaacgacatcatccacacccgccaacacgaagaccgaatggacaccttgggcaaagtccgcaacgccggtttgaaagtctgctgcggcggcatcgtcgggatgaacgaaacccgcgccgaacgtgccgggctgattgccagtctcgccaatctcgacccgcagcccgaaagcgtgccgattaaccggttggtcaaagtggaaggcacgccgcttgccgatgccgaagatttggactggacggaatttgtccgcaccatcgccgtggcgcggattacgatgccgcaaagttatgtccggctgtcggcagggcgcagcaatatgcctgaagcaatgcaggcgatgtgctttatggcgggcgcgaactcgattttttacggcgacaagctgctgaccacgggcaatcctgatgaggacggcgacagaatcctgatggaaaagctcaacctgtatcccttgcagtttgaaccggaaggcgaggtcgccgaagtggaaaaagcctctgggattaaagtggattattgacgattgaaaaatgccgtctgaaacccggaaaaaggctttcagacggcatttgtccggacggcatttccaatatctttttaccggcgcgtgatgctgccgtcgggcgagacatccagcccgttccccttggggaaatcgctgcggttcagataaataatccgcccgataacggttttctcggggtcgattttggggattttatcgccgacttgagtgatggggataatgttgccggaaacgaaccgcccctgtttgtcggtgataattttaaaaatgggggcgatgccgctgatgccggaggtgttgattgcgccgtaggtggcaaagttgccgccgctgtaggagatgaagcggtcgcggtaaagttcgacggcgcgagtaacgtgcggcccctgcccgaatacgacatccgcgccggaatcgacggcaagccgcgcaaactcaacgacgttgcccctgttttccccatagaagatttcggtatcgaacggcaggtgttccgcctgtttcccttccgcgccgccgtggaacatcacaatgacgatgtcggctttctgtttggttttggtaatccgttttctaactttggcataatcgttcagtttgacggcggcaaggttgggggcgaaggagacgaagccggatcttacgccgtttttcttcaggatggcggtttcaaacctgttttcgatgcccgaatatttgatgttcaattcgtcaaggttcgccctttatgccgtttccgcaccgcaaaccgccggggtcaagccctcggcgcatcctgccggaacggaatccccgtgctgccgattgacggttcaaaccccgcgcccgtttcaaataccggcgatgtggacggacaggatgcgcctgacgaaaagacagccgataccgtttccattatcggcgtgggcgacattatgctcggcagcaattatccggtcgattacctgcccgataccaatattctgaaaaacgtcgaatctgccttgcaagacgcggacattaccgtcggcaacctcgaaggcacgctgtttgacgaaggcggtacgccgaaaaaatgtgcaaacccccaaaatatgctatgcattccgaacgccctccgcatacgggcaataccttgccgacgcgggattcgactacctcagcttcgccaacaaccacagcaacgacttcggcgcgcaaggcatcacggcaacggcggcgagcggcagctcttttacatactcgatcgcgctaaagccgctgccgataacgaggccaaaattgcggaaaataccgccatcgcccagataaatttgtccatcatcagacctttactgttcagacgagacagcatttgccgcacgttttggggcttatctttcgatttgcgctacgtcgcgcaccgcgcctttgtcggcggaagtcgccatcgcgccgtaagctcttaatgcggcggagacgtagcggtcgcggtttttaggcttccatgctttgctgccgcgcgcttccatttcggcacggcgtgcggcaagctcttcatcggaaatggcaaggtggatgctgcggttggggatgtcgatttcgacggtatcgccttcgtgtaccaaaccgatcgcgccaccttccgccgcttcgggcgaggcgtgtccgatggacaaacctgatgtgccgccggagaagcgtccgtcggttaagagagcgcaggctttgccgaggcctttagatttcaggtaggaagtcggatacagcatttcctgcatgcccgggccgcctttcgggccttcgtagcggatgatgacgatgtcgccagcgacgatttggttgcccaaaatgccttctactgcgtcttcttggctttcaaacacgcgggcgcggccggtgaatttgaggatgctctcgtccacgcctgcggtttttaccacgcagccgcgctcggcgatgttgccgaacaagaccgccaaaccgccgtcttgcgagtaggcgtgtgccacgtcgcggatacagcctttttcgcggtcgaggtcgagggttttccacatacggttttgcgagaacgcttgggtggtgcgtacgccgcccggcgcggctttgaagcgttcgatggcacgggtgttttcgggattggtcacgtcccattgttcaatcgcgtctttcagcgtcggcgcgtggatggtgtgcacgtcggtgtgcagtttgcccgctttgtccagttctttcaggatggcgaagataccgccggcgcgatgcacgtcttccatatagtagtcgtggttgttgggtgcggttttgcagatgcagggcacgacgcggcttaagcggtcgatgtctgccattttgaaatcgacaccggcttcgttggcaacggccaacaggtgcaaaatggtattggtgctgccgcccatcgcaatatccatcgtcatagcgttttcaaacgcttttttggtggcaatgctgcgcggtaacacggtttcatcgttttgctcgtaatagcgtttggtgatttcgacaatcatacggccggcttcgaggaacaattctttgcggccggcgtgggtcgccaaatacgaaccgttgccgggcagggaaaggccgagtgcttcggtcaggcagttcatcgagtttgccgtaaacatacccgaacacgagccgcaggtcgggcaggcgttttgttcgacttcctcgacttgccggttgctgacattgtcgtccgccgattcaatcatcgcgtcaatcaagtccaaacggcgttcgggctggatgtttgccacgccgataaccttgcccgcttccatcgggccgccggagacgaagatggtggggatgttcaggcgcatcgcggcaatcagcatgcccggggtgattttgtcgcagttggaaatgcacaccagcgcgtcggcgcagtgggcgttgaccatatattcgatagagtcggcaatcaaatcgcggctgggcagggagtacagcatgccgctgtgtcccatagcgatgccgtcgtcgatggcgatggtgttgaattctttggcgattgcgccggctttttcgatttcgcgggcaaccagctggcccatattgtgcaggtggacatggccgggcacgaattgggtgaaggagttggcaacggcgatgatgggcttgccgaagtcggtttccatcacgccggtggcgcgccacaatgcacgtgcgcccgccatattgcggccgtgggtggaggttttggagcggtattcaggcatagtgtgtttccttgtgcctataccgtctgaaagacagggctgtttcagacggtatcgggtacggttttttagagtgggaaaagagggtattttataccaagtatcggaattttgcgggattgaaacggcgtgcggcaaaaaagaaaatccccgcaggaatgcggggacgggttcaggcgcgggcaatcgcgacggctttggatgcgtcccaaaaatcaacgggtgcatttaatacgggtttgacgatgcccgtccgtatggcgaaatcgccgaaaccttcgccgatattgcgttctgccgcccatttgccgatcaggtcgtccaattcggcaaggatttcgggcagggtgatgttttctttgtaaagacgggggatgcgtacgccttcacggtcgccgccgatatggaggttgtagcgtccgacggctttgccgaccagtccgatttccgccaacatcgcccgtccgcagccgttcgggcagccggtaatgcgggtaacgatgtagtcgtccgacgtgccgtgtttcgccataatcttatccagctcgccgatgaagtccggcagcacgcgttcggcttccgccattgccagcgggcaggtcggaaaggaaacgcaggacatcgcattttcacgcagcttgctgacatcgttgcggattaatccgtatgttcgggcaaattcttcgatttttgctttgtctgcttcggcgacatttgccacgatgaggttttggttggcggtgatgcggaaatcgcctttgtggattttggcgatttccaacacgccggtcagaagctgtttcccgccttcgtcaaccaaacgcccgctttcgatgaaaagggttaaatgccagttgccgtctatgcctttcacccagccgatgcggtcgccgcgcccggtaaatttgaacgggcgtacgggttcgaacggcatacccatacggcgttcaacttccgcgcggaagttgtccaagcccatattttgaatggtgtagcgggtgcgggcgtttttgcggtcgctgcggttgccgaagtcgcgctgcgtggttaccaccgcttcggcggccttcagcgcgtgttccggaggcacgaaacccagttccagtgaaatgttcggataggttttggtgttgccgtgttccatcgaaagcccgccgcctgccaaaacattgaagccggcaagctgtccgttaccgtctgaaacggcgacgaaatccaaatcgttgccgtagcagtccacatcgttcaagggcgggatgacgactgcggttttgaattttcgcggcagataggttttgcccaaaatcggctcgtcttcttgaaggaagtcgtcggaactttgaacttttttgccgtccacccacacatccagataaccgcgcgtgcgcggcagcaggtgttcggaaatctttttcgcgtattcgtaagcctgccggtgcagttcggactcgatcgggttggacgtgcaaagcacgttgcggttcatatccgccgccgtggcgatggaatccaaacccagtttgtgcaagaggcggtgcatcgtctgcaacttggctttcggcacgccgtgaaattggaaggtttgccggttggtcagccggatggagcggtaatgactgttttcccgggcaaatttgtccagttctatccattgggacggtttgatgatcccgcccggcagccggcagcgcaaaagcataaatttcaagggctcgagttttgcctcggcgcgttcggcgcggatgtcgcggtcgtcctgctcatacataccgtggaagcggatgagttggaagttgtcgcctttgaagccgcccgtgagcgggtctttcaaatcgtccaaaatcgtgccgcgtaaaaaattgctttcggttttcagacgttcgttgtcggatagcggtttttcttgccacgccaaaccttttgtcttggtctgtacggtcattttgtgttcctcccgattatatttaatcaataaacatcacgctgatagcgtttttcttcgcgcagcatatccaaatattcttctgcgccctcttcgtccaaatgtcctgccccgataatcacatccagcaaggcggcttccacgtcttttgccatttttgccgcatcgccgcacacatagatatgcgcgccttcctgcagccattgccaaagtccttccgcctgttcgcggattttgtcctgcacatagattttttcttcctgatcgcgggaccaggcgaaatcgtacctgtgcaggaagccgtctttggcaaactgctgccattcggtttgatagagaaaatcacgggcaaaatgcggattgccgaaaatcagccagtttttgccttccgcattttctgcggcacgttgttggacgaaagcgcggaacggtgcgacgccggtgcccgagccgatcatcacaatcggcttgcggctgtcttcgggcagcctgaagccgtcgttgcgttccacaaacacgcgcaccgtgccgtcctcttccagccggtcggcaaggaaacccgatgcgccgcccgttctggcgcggccttcgtgttcaaaacgaaccacgccgacagttaaatgcacttcatcgcccacttccgcctgtgctgaagaaatcgaatacaaacggggtgcaagcggacgcagtaaacggatgaattgttctgccgtcaggcttgccgggaagcggtgcagcacatcgacaataggcgtgttttgcacgaaatcctgcaaaacggcgttatcggcaatgattttatcgagttcttcataatgggcgaacgcggcatagcctttgacgaaagccggagtgttttgcgtgagttcgaaatgagatgaaagtgcgcgcgcaaccggcatcatctttccgcccgcctgtatttccgttgccggatcgatgccgagcaggtctaggatttccctgaccagtgccggatcgttgtcaaaccaaacgccgagcgcgtcgcccgggaggtagtgcaaatccgaaccgctcaaatcgatttcgatgtggcgcacgtctttatcggattggcgggcggtgattttctgattggccagcagggcggcgggaaagggggctgccttgcagtacctgccatccggtgccgtctgaaggccggcggggggcgttgtctgcggcgcgggcgttgcccggttttttgcggcttcttcttttaagagtgcggcgatattatctgtccaggcgtttgcggaggcggtaaagtccaaatccgcatcaacgcgttcgagcagccgttttgcgcccaattcttcaaaacgccggtcgaaatctttacctgcctgacagaaattcggataggaactgtcgcccaaacccagtacggcaaattggagtttgtccaatttcggggcttttttgccgttcagcagtttgtgcagcacgacggcttctttcggcggttcgccttcgccttgggtggaggtaaccagcagcaggcggcgttcgccggcgatgtttttcgccttatagtctttcagttcggcgcgactgacttggatgccggcggcttccaggctgtccgccgctttgtcggcaacggatttcgcattgccggtttgcgaggcggaaaggacggttacggaaaaaggttctgccgccggcaatgccgtctgaagcgcgggcagtcctgcagatgccccgtttcctgcttttgcccaagcgtagccggacagccacgcccattgtgccgcgtccagccccgacaggagctgcgtgatttcgggcggcagaggcggtaatggcggatttgtgttctgcatatcgtgttcactcataaaatcatacctgccgcaacagtgccgtatgtcgcttcgtctatcaggataaacgaaccggcggcggtgttttccgcataaggcgttgccgtaacgggtttttgaaggttgatgcggactttggcgatgtcgttcatcttcaaggattccgcgccggcctcttgttccagcgtgcggacatccaaaacgctttcaatttccccgacttttgccggcacggtttgcgtgccgtgcttgagcaggtatttgcgcgcggtgttgagcggacgttcgtcaaaccagcaaagcgtggcttccagatgtttttgcggggcgagcggggaatttttatcgacaaaaaggtcgccgcgcgaaacatcgatgtcgcggtccagccggagggttgccgcctcgccggcaaaagcctgcgccacttcccctttcggcgtgatgatttcggacacttcggcggtcagcccgttcggttcgatgcggacggtttgcccgacggcgaccgaaccgcgttcgatgcgcccctgatagcctcggaaatcatcggccttgtcggcatcttggcggacgaccagttgcacggggaaataaaaatcgtcggcggtgcggctgacttcgtccgcccccggcagggtttccaaaatggacaataagggttcgcctttataccaaggcatattgccgccggggtaaacaatgttgtcgcccaagagtgcggacatcggtacgaaatgcgcgtctttcaaaccgagctgttcggcaagtcggcggtatgcctccacaatggcgttgaatttgtcttcgctgtaatccagcaggtccattttgttgaccgccaccacaatatgcgggcagttgagttggcggaggatggcggaatggcgtttggtctgcggcagaagctgcaagggctgcgcgccgaaatccagttgggatgcgtcaaccagcacgactgccgccgaagcggtgcttgcgcccgtaaccatattgcgcgtgtattgttcgtgccccggcgtgtcggcgatgatgaatttccgtttcgccgtggaaaaatagcggtatgccacatcgatcgtaatgccctgttcgcgttcggcttccagtccgtcggtcaggatggagaagtctatggcttctttcaaacctttgcttttgccggattccaaggttttgatttggtcggacagcagggctttgctgtcgtagagcagtcgtccgatcagggtgcttttgccgtcatcgacgctgccggcggtaatgaagcggagcggggtttggtgttgtgccgtcatattttcttcctcatatctgcttaaagggtttttgaaatttagaaatagccttcttttttgcgtttttccattgccgcctcgcttgcctgatcgtccagccgggtcgcgctgcgttcggaaatgtcggcaaccgctgtttctctgataatctccgtcggcgtggacgcggtgctttctaccgggcaggtgcagctgatgtcgccgacggtgcggaagcggacatcaaggatttcggaggtttcagacggcattttcggggtgagcggcgttacagggaccagcagccccctgcgtctgaccacttcgcgcctgtggctgtaataaatcggcggcagctcgaggttttcgcgggcgatgtattgccagatgtcgagttccgtccagttggaaatcgggaagacgcgcatattttcgcctttgtgcagcctggtgttgtacagcgaccacagctcggggcgttgcgccttcggatcccattgtccgaactcgtcgcggaacgagaaaatccgttctttggcgcgggctttttcttcgtcgcgccgcgcgccgcccataagcgcgtcgaagccgtttgcctcgatggtttccaacaaggtaaccgcctgtgccgcattgcgcgaatcggtttctttgcgtaagaccaccgtgcctttggcaatggagtcttccacgcgccccactatcaggcgggcattgagttttgccgcctgcgcgtcgcggaaggcaatcacttcggggtagttgtgtcccgtgtcgatatgcaccagcgggaagggcagtttcaccggccggctgcccagccggaaggctttgcaggcgagggcgagcaggaccacggaatctttgccgccggaaaagagcagggcggggttttcgcattctgccgccacttcgcggatgatgtggatggattcggattccaaccagtcgagttgggcgttgttcggttcggttttcgtcataccatattccttatttcttctgtctgatatttatgaattatttgtgcagcccgcattctttgctgtttctgccttcccaccaccaccgcccggcgcggatgtcttcgcccgccttgacggggcgggtgcaggggtcgcagcctatgctgggaaatccttgccggtacaaatcgttgtaaggcacattgttggcgaggatgtatgcccacacgtcgtgttccgaccagtcgaaaatcgggttgtatttgccgatgccccgtccggcatcgtattcggcaaacggcagttccgtgcgtgtggcggattgttcgcggcgttgcccggtaagccaggcgtccgcgcctgcaatggcgcggttgagcggttcggtttttcggatgcggcagcattcgcggcgcgcttcaacgctgtcgtaaaaggcaaacctgcctttgctttccacataacggtcggcatcttctcgaaccggccggaaacgctttatccgcaaatggggatatgcgcgtccgagcctgtccagcaggttcagggtttccgtgtggagcagccccgtatccaaggtaaaaatgccgatattgaggttttcgccggcgataaggtcggtaatcaccatatcttctgccgcaaggctgctggcaaaccgtgcatcccggtggctgccgacaatccggtgcaggcgttgtttgagggtttccgttttttccgcaagggcggtttcgccgccggatccgatatgcggtatctgccacagggcgggtttgaacagtgtcgtttccatttttcccgccttatgccgcccgttgtccggcattcagtccgcccaatgcgggatacgtctgcccgacccggttttctccttcgccgttttcaccgaaccaggcgagtttttcgtgcagccccaccacttcgcctatgacaatcaatgccggattcggcgcggtttcggcgagttcggcaaggttggcgagcgtgccggttgcggttttttgagccggcagcgtgccttggctgataacggctgccggcgtgtcgggcgagcgtccgtgctgttgcagccgttcggcaatcagggcggctttgagcgcacccatataaatcaccaaggtctggcggctgcgggcgagggtctgccattcgatgtcgggcgcatccgccttgcggtggccggttacgaaaaccgcactttgggcataatcgcggtgcgtgagcgggatgccggcataggcggtcgcgccgacggcggcggtaatgccggggacgaccgaaaacggaatctgatggcgtgccaaggtttccaattcttcgccgccgcgtccgaacacgaaagggtctccgcctttcaaacgcaccacgcgcctgccttcgcgggccagcctgaccataagcgcattggtgtcctcttgcggggtgcgctcgccccgggcgcgcttgccgacaaaaatccgttccgcatcgcggcggacgagggacagtatgccgtctgaaaccagcgcgtcgtaaagcaccacgtctgcctgctggatttcctgcagccctttgagcgtcagcagccccgcatcgccgggacccgcgccgaccagcgagacggagccgccttgatcattttgacgactttgttccaattggcctgccaattcccgttcggcaagggtgttttgccggtttttgacgagggcggcgaaacgtccgttaaactgcttttcccaaaagcggcggcgttcggtaacggatttcagtttgcccttgacggcatcgcgccaccttcctgaaatttccgccatatcgcccaaagacggcggcagcagggcttccagcctttcacgcagcagtcgggcgaggacgggcgcgctgccggagctggaaacggcaatctgaaccgggttgcggtcgataaccgacgggaagatgaagctgcaatggtcgcggtcgtccaccacgttgaccggcttttggcagctttcggcaagatggaaaacgcgccggttgagggcttggtcgctgcttgccgcaatgatgaggaaaaccgtgcggatgtgttcggcacgaaattcttcggcaagccacaggattttgttttccgccgccaacgcggagagttcggcattcaggtgttttgcggcaaccctgacctctgcgcccgccttcagcagcaggctgattttgcgtgcggcgaccgcgccgccgcctacgaccaatacggggcggccggcgaggttggcgaaaatagggaaataattcactggctgactcctttgctgtttgcccgcaccttgtttccgatacggtgcgtcgcggcatttttgtcggaatgcgggtcattttagacaaaaggattttccccggttaaataataaaaaggtatttgttagaagctgaaagctatatgggggcggctgcggatgcggcggttttccgttttataacggtttcggaagaaaaacggcctgaagccgtttcgggcattcagaccgtttgcgtggtgaggggatgccgtccgaagggcgaaaagggcttcagacggcattgatgtcgggtttcaggacaggagcaggatggcggctgcggcaagcgaggcaaccgataatgcggcggcaagcgcggctttgcctgcaaagcggattgaggttttgccttcgatgtatttgaagccggttatcatcgggaggatgaggtttttctttttgaatacgcggtatgcggcgacggcggcgatgtggattgcagaaaaaacggcgagcagcttgaaaaagttgaggtggattttccgcataaggctgcccgtatgttcggaaaccaaatggttgaggtagccgttggtgctgaaggtgttttcatcggcggcaaaaagcccggtgccgacttggaaggacacggcggccaaaagcgcaacgaccatcagtgcgcccaaggggttgtgtccgggctggatgtgttcgggaataccgtttttcagatagccgcgtatgcctgcccagccttggacgaaacgggaaaaacgggcggtatcgctgccccaaatgccccagcagaggcgaaatacgagcaggaaaaggacgaacagcccgacgcgcgtgtgccattgcagcatatcgccgccggctttcgcgctataccacataaagggcagggacgcggcaagcagccagtggaaaaggcgggtggggaggtcccagactttggttttgtttttcataatcggtttccggcggtagaatcggtttgttttcgagccttattttaaccgattggaggggcaatgtttcccgtttttcatctttcaggcgagagccgccgccagatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggcaaagtgtgggcgggtttcaatcaggatacgctaccttttgccgttattgccggttttcccgagattatgctggatacggcggacagtttggccaaacgtcaagatataaacgcctgggttgtcggttgtggattgggtacaggtagggcggcggtcggaacgcttgccggaattttgacggaacacacggacaagcccgtcgttttggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccgtctgaaaggcaagggcttcagacggcatcttcatttcccaaatactgtccggtaaagcgtggtataatgcgtagttatctcttacagtttttgaaaaacattaattatgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaacaaaatcgacaagccgtccgctcgtccgagctgggttatcgaccaaactttcgagctgttcgacaacttgggcgcgaccgacgagcagttggatttcccgattgtttacgcttcagggttgagcggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgcatcaaacccggccaaaccgttgccgtcatgaaccacgatcagcaaatcgcccaaggccgcatcaaccagcttttgggtttcaaaggtttggaacgcgtgccgcttgaagaagccgaagccggcgacatcgtgattatttccggtatcgaagacatcggtatcggcgtaaccatcaccgacaaagacaatcccaaaggcctaccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggatgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggcatgattatcggcatccacagtcgcgacaacgatttggtggtcaacccgctcaaaggcaaaaaacttaccaacatccgtgccagcggtaccgacgaagccgttcgcctgaccacgccaatcaagctgacgctggaaggtgcggttgagtttatcgacgatgacgaactcgttgaaatcacgccgcaatccatccgtctgcgcaagcgttacttgagcgaattggaacgccgccgccactttaaaaagctggattgatgtttactggattaatgtttaaatgatacgcgatgccgtctgaaaaatttcagacggcattttttattcggacgggctttgcggcttcttgaagctgtttcagacggcgtttttcctacccaatcaagaaactgccgccatttttccagcggtatatcgccccgtcgcgtttcggtatcgggttcggcttcccggcagcatgtcgaacaatgccgtttgaaggaatacgccttttgagtccttacaggctgaggaagagggtaaaacataccgcaaaacataccacaaaaaacggtaacggatagttgtaagcggttgatgacgattatagacaataacgggttttcccaatgaaattattgtttgaataataaaaaatcccaaaccgtaaaagtttgggatttgtatttggcagagaggaagggattcgaaccctcgatacgctattcacgtatacacgctttccaggcgtgcgacttaaaccactcatccacctctctaatggcggaaattatcccaatcgggataatttattatttggtgcccgggagaagactcgaacttccacacccatgaggataccagcacctgaagctggcgcgtctaccaattccgccacccgggcaatctaaatattgaaataaagcaaagcatttgatttggtgcccgggagaagactcgaacttccacacccgtgaggatactagcacctgaagctagcgcgtctaccaattccgccacccgggctttgctttatttgctgttttgcggtacagtgtcctgccgcaaagaagtcgctattatatagttcataaagagaatgtcaacagtccaaatgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcgcgcgagctgtcgattacggaagacgagtatgtcttttttgaacgccgtctgaaggcgatggcgcgggacggtcaggttttaatcaaccgtcggggcgcggtttgcgcggcggacaaattggatttggtcaaatgccgcgtcgaggcgcataaggacggtttcggttttgccgtgccgctcacgcccgccaaagacggtgattttgttttgtatgaacgccagatgcgcggcattatgcacggcgatattgtcactgttcgtcctgccggcatggaccgtaggggccgccgcgaagggacagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataatgctgacggggtggcttgaggaggcggggcatattttcccgaagcctccacccgattttttgatgtgggcggacggagcgttatttccagcaaattgaaacgcccgtattgaaagattgcgtttatttccaccgccgttttaaaggccggcggtattcggcagacggggcgcaaacggcgttcagacggcattttcattctttcggcgtgtccgtccgaattgctttgcccgtccgcgcaatcagcccgtgcggcttgccttgaacggacaaaaaatgccgtctgaaacccgaaaatcaggtttcagacggcatttttccttgaaaaggctgttcaaatcagcgatggtagttcggtgcttctttggtaatttgaacgtcgtgaacgtgcgattcgctcatacctgcggaagtgatttccacaaattctgctttttcgtgcatttcggcaatattggcgcaacccaaataccccatgctggagcgcagtccgccggtcagttggtggatgatgttcacaatcgggcctttgtaaggaacgcggccttcgatgccttcggggacgtatttgtcggtgctgtcggttttgtcttggaagtagcggtcggcagaaccttggctcatcgcgcccaaggaacccataccgcgataggatttgtatgagcggccttggtagagttcgatttcgcccggcgcttcttccgtgcctgcaaacataccgccgagcatgacgctgtacgcgcctgcggcgagggctttggcgatgtcgccggagaagcggatgccgccatcggcaatcagcggaacgcccgtgcctttgagggcttcggcaacgttgtgaatggcggtcagttgcggcacgccgacacctgccacgatacgggtggtgcaaatcgatcccggaccgataccgactttgacggcatccgcgccggcggcgaccaaatccaaagcggctttggcagtggcgatgttgccgccgatgacttggatgtgcggataggtttctttgacccaacgcacgcggtcgatcacgccttggctgtgcccgtgggcggtatcgacgacaatcacgtccacgccggcctcaaccaaggctttgacgcgctcttcggtgtcgccgccggtgccgactgccgcaccgacgcgcagacggccttcggagtctttgttggcattgggaaactcggtggtttttaaaatatctttgacggtaatcagacctttgagttcgtctttttcgttcagaaccaaaacgcgctcgactttgtgcgtgtgcatcagttcgcgcgcttcgtctatgcttgtgccttcggggacggtaaccagacgttcgcgcggggtcataatggcggaaacgggcaaatcgacgcggttttcaaaacgcaggtcgcggttggttacgatgccgacgactttgccgttttcaacgacgggcaggccggacattttgcgtttgcgctgcgcacgcatttccaagacttcgcggatgagcgttgtcggtgcaacggttacggggtctttgaccacgccgctttcgtggcgtttcactttggaaacggcgcgcgcctgcatttcgggcggcatgtttttatggatgatgccgatgccgccttcttgtgccatcgaaatggcgaggcgcgcctcggtaacagtgtccatcgcggcggaaagcagggggaggttgagtgtgatttcgcgggtgagcttggtttgaagtttaacgtctcgcggcagcacggtcgaatgtgcgggaaccaacaaaacatcgtcgaaagtataggctttttctacgatacgcataatgctcggtctttcagtttgtgcaagatgcacggcattatagcacgttaccggcggcttgacagtttatcaggtttaattttggtcccctttgaatagctcggttttcctttgccgaccactgttgctcccgttctttcaatttcaggaaaagcttttttctaatttttggtaagtggctcagttattgaagccctatatcgggcggtaacttccagcacaaaaaaacggagtagttctttatttattttttcctttaattttcagtatattatcttaatatttcgagggtaacatatctgctaatctagttacagccccatatattatagattcaattgaaaaataacagattcaactgtacctttcttatacctgatttctttaaagtttttcccattgtcaaaactataaaaaagtctctcttcctcaccagaatatcccatttctaatactaaacaatctatttcacaattaccccctccactcatatatgtagtatcaatagaaaatatattgcataattccagagaattatatttatctatatcaaatagttgctctccaaaatctaaaccattgtttccacctgcataatacttctcttcaaaggatgacttcaaactattaaaaactgcatttagcgtaaaatatccatatgggcatatcttaggatatatattctctcctattattatctgaatttttccataaataaaaccattacattcagagttttcttcccataaaatcccaaattttcttgttgagtccataataatattcatataaatccttatattaataaattatttacaatatcccccgctttcagacggcatacggcgtggcggcggaatgccgtctgaaggcgggcgttatgataattgttccagcagcgtctgcttcaatgaggactggatttttgggtttttcaggtcggggctaaaaacggtaaaactgtcttcggcgcgttcatccagtgtggagattttggcatagcgcaggctgacgttgtgggcgaaaaagacttccgccatatcggcgagcaggaaggggcggttgacggcggtgatttcgacggaataccagtcgggatagtcttcttcgggggtgatggtgatgctcggtgcgatcggcatatagcggctgcggcggctgatgcggcggctgcggctttgggtttcggcaacggtgtgtccgtggataaagctgttgagttcggcttcgagcgcgctttggatgtcggggtagtcttcgggggcgtgctgcgaggggatttgcacgatgaaggtgtcgaggatgtagtcgtgttcggtgatgaaggcgcgggcggcgaggatgtcgaagccgtggcggctgaagatgcggcagaggcgggcgaacaggcgcgggccgttgggcatgaaaaccatgacttgaaagctgtcgcttttgggcaggatgcggctgcggacgatgggggtttcaaagtcgtggactaggttggcggcgtgccacaggatttcgcgggactggtggcgggcgaagtaggcggaaccgagcgcgttccatagttttttctgctgtttttcggggacggcggcgcgggtgagtaagtcggcggcttcctgccggcggcggccgaagagggtgtgcgggttgccgccgttgcctgtaaggtagcgtccggcggcatggaagaggctttccagcaggctggcgcgccatgcgttccacagcttgggattggtgccgcgtatgtcggaaatggtcagaaggtagagcgcgctgaggcgttcgtgggtttgcacgcgtttgcagaaggcatcgagtacgctggggtcttggatgtcttctttttgggcgacggcagacatcagcaggtggttttcgaccagccaggcgagcaggtcgctttcttctccggtcaggaagtggtcagcggcaaattggcgcgcgtctgcgatgccttgtatggcatggtcgccgccgcgtcctttggcgatgtcatggaaaaaggcggcaaggtagaggatgtcttgtttttcaaaggactgcatcagtgcagaggcgtagggcagctcgtggctgtgcatatccaaggcaaggcggcggacgttgcggacgacggtgaggatgtggtcgtccacgggatagatgtggaacaggtcgtgttggagcaggccgatgattttttcccacgcgggcaggtagcggcccaacacgccgtagaggttgagaaagcgcagggtctgggtcagcccgttgccgttgcggaaaaaaccggcgaagcggcggcggttttcgggattttggtagaagctgcggttgattttgcgcgtcgcgccccaccaggcgcgcagggtttgcggttcgagcgcggtaatgtcgttgcgctgctgcatgatttcgacgattttgaaaatgtgttcgggccgtctgaaaaaaatatcggtgtgccgcgcggcgatttggttgttgacttggatgtagtcgtcgtcaatccgcagggtaacgcgcaacggggtggaggaaacgcggctttgcagcataggcgtgaggatgccgcccagttgtttgacggttttaatcgcgcggtaaaacacgcgcatcagttcttcgctttggcggcggaggttcaagccttcataacccatgctttcggcgacttgcggctgcaaatcgaacagcaggcggtcttcggcgcgcttggcgtttaaatgcagatggatgcggatgtgggcgaggcggcggtagccgtgcgaaagcataccggcttcggcacgcgtcaaaatccgctgtttgagcaggtcgggcaggtcggtcgccaagccttgcgccttcgctatccaaagcagggtgtggatatcgcgcagaccgcccggacagcttttgatattcggctccaatactgcccccgaaccttgcgatttggcgtggcggtgttccatctccaccagttttgcctcgacaaacgccgccacattgcgctgcgcgttcattttttccgccagtttatccaccgtttggcggttgccaaacaaaaacctagcctctaaaaacgctgtgtcccccgtaatatcattgcgcacgctttcacatagttcatcaacgctgccgctttttacagacggcatcagtttgcagtcccacagggtttgaacaaaccgggcaatctgttcctgaatgccgtctgaaagcggggcaggggagacaaccgccaaatccacatccgaacagggatacagttcgccgcgtccgaagccgcctaccgccatcaggcataacgcgctgttttgaaaatactctgcccacaatgccgccagtaaggtttcgactgccgccgtgtattctctgaaaaataccgacacgcggttggctttcaaataatgcgcttcggcggcatcgcgctgctgtttgaaggtttccagtgctgaagacaggtttgcaggcatttttattctttcgattggcgggaaaaagggaggcggatggttcggcggtcaaataccgctttcagacggcatttgtcgggtatcggcggaattggtcatcagcttcaaccgttcctgcggcggcagcagcaactgatacgccgccacgcccaaagccgccgccattttttcgatattcgacagggcgatgttccagcgtttgcgctcgactgccgacacataagtcctgtccaaaccgcattgccgcgccaattcttcttgcgaccaacccttgttcacgcggaaaagccgcatattgtatgccaataccgcccgcaaatcctgttcgtcaggcagttcggcaggcagagtcaatttgttgcccatcatttgcttccagataaatggttaaagttaagcatttgctgttacggattttacttcacataaaagccaaaaaaaaggggtggcggcagccacacccaaacacacacacatcaagaggaaagagataaaatcaagacagattgggaaacagcaaacaagcaccctgaatttcatatcggtattatcaaacaaaaacccttatcaggtattgattcaaatcaatttagattttattcgcaaaccgaaaaagaaaaacggcatatccgtttatacggatatgccgtctgatggtgcgggggactgctgtatttggcagtggtttgtgttttagtcctcttgcgccgctgtttgcaggtagttcggcagaccgattttgccgataagctcttgctgggtctccagccagtctatatgttcttcgttggtgtctttttgtttttccaacaaatcgcggctgacgtaatcctgttgcgcttctgctgtggcgatggcggcaagcagggcttcgtgtttttcctgttctttggtcaaatcgcaggcgatgatttcttcggtggactcgccaatcagaagcttgcccagttcttgcaggttcggcagaccttcgaggaacagaatgcgctcgatcaaatcgtcggcagctttcatttcaacgatggactgtttgaagaaatgttcgcccagttcttcaaagccccagtttttcaaaatacgggcgtgaaggaaatattggttgatggttaccagcagcaagcctaagtttttgttcagctcgcggataaccaaacggtcgcctttcatacggactccttttattccgaatacggattacagttggctttggtagtagttgccttcgccaattaactcgatcaggcgaagctgctgttccagccagtgggcgtggtcttcttcggtatctttcagttgggcaaccatcaggtcgcgcgtaacatagtcttgagcctcttcgcacagtttgatgccttttttcaacgcatcacgtacttcatattcggtttgcaggtcggctttgaggcaggaaaccacgtccgtgccgatattcagttcggcgcgtgccattttcggcgtaccgcccagcatcaggatgcggcggatgaagtcttcggcgtgtgtggtttcttcttccatctcgtggttgagacgttcaaaaagtttggtgtagccccattcggagtagaggcgggagtggataaagtattggtcgcgtgccgccagctcgccagacagcaattcgttcatataatcaacaacagcttgattgccttgcataatatctctctttctgtaacttggttttcggtatgtctgaacagcatctgtgtcgctattcgggatgcgtgcattgtatgcaaaagctgtcggcatgacaaattttctatttaaaatacaaacaattatcaaaagaaatagggcgtattccccgatgccttccaaatcagtatgctgtttcttatcggtttttttgctgctaaaactaagaatccatctcatccataaagaacatttacacttattaaccatagcaaaaaacaaatagagcacggttttttatcaaaatttataatgaatcgttctcattaaccgacagattcttttgagattatcggattttgggaataaattatgccgtctgaggggctttcagacggcatgcctgcccggacagacgctgcttggagcggctgtcggtttgaaggtgtgtttaatgcgaagggcaatctgtcgtatgatgtgtttgcggcaggggctttgaagaagcccggtattttaggacgaagcgcgcggctgccggggtcaatatccgctatttattccaaaccttattaaaacttaaatttaaaatcatgaagatagaaaatatcgatattatttcgccggaactgttcccgcaggaaacattcaatgaaaccgaagcattcggcgctttggtatggttgtgggcagtttcgcctatttatcagcatgccggcgtacaagaagccgccgtcaatatcttgccggtattgaaaaacgggcaatttgccttgttcagcagcaacggacaccccgtcgcctactgcacttgggcttatttcgatgaagaaaccgaatggcaatatctccaatccaatgatgttctgcgccactcggaaaactggtgcagtggaaacagaatgtggcttatcaactggttcgcacctttcggcgacagccgtatgatgaaaagaattctggtgcatctgtttccgaaacgtgaaataaggtggctgtaccaccgggggagtgaaaaaggaaaacggattatgaggtttccagcgttgtcgaaacaataaaacaaggctgcctgaaagtttcccttcaggcagccttgtttcagttctctcgaggccattcgtattttttgttttcgggataaatgtcgtcacctacacgataccaacctctttttctcatgcaggcatctgctttacttcctcctcccccacctattgggtcatagccgcactctttccagtctttttttccttagcaaaaagatcatctatttgtttgctatattcttcataagaatatatgcgtaaattgatatttttactcatcattgccggatattcttgttctatacgggaatacttccagtataccgagtcatcgggcggaggtttgaatcccccaaacgaacaggcagccaatcccatagccaaagagattgatacgatatatttcattttgtttttccttcttctcgaggccattcgtattttttgttttcgggataagggtcgaaacccttacgacaccagccttttttcctcaggcaggcatctgcttcagactttccgccgtctattgggtcatagccgcactcttgcatgtctttcagttgccttcgtcttgctttcgatggatattggtcaagtgccgccgaggctgatcccggatagggattggcgtaatttttcaattcccaaaatgacgcggcgtcccacggatttggtttaaatcccccaaacgaacaggcagccaatcccatagccagagagattgatacgatatatttcattttgtttttccttcttctcgaggccattcgtattttttgttttcgggataaatgtcgttacctacacgataccaacctctttttctcatgcaggcatctgcttcactcccaccgcccccacctattgggtcatagccgcactctttccagtcttttttttctctagcaaaagaatcatgcagttgtcttcgtctctcttcaggtgggtattggtcaagtgtcgctgaggttaatcccggataaagtttggcgtaatttgtcaatctccaaaatgccgagtcatcgggcggaggtttgaatcccccaaacgaacaggcagccaatcccatagccagagagattgatacgatatatttcattttgtttttcctttcggatgttgcagatcataaatgcgtacaggacggtacataatttcgatttcgttggacactcctctttcaaatacacctgtcggactttgggtttgtttattttcagggtctcgataaccatctgttacacattgtttattagccataccgtagcaattatgcggcgaggtgtaatcccctataatatcccttatagcctgccattggcttttttgccgggtattggttccgactgttgccggatttctgccaatcagcatgccgataaggtctaattcgtggttttctatttggatggactgacgggcgaaatctgccgttctgggtgtcgttaccccctgctgcagttgaaacagccttttatctgcccggacaacgttggcggcagggccgaccattttcagttcggtattggataaaattttcttatcccgattggcttgggtattcaaggtattgagtacattgtcgaccaccagggttccacggctgtgcgagccgacaaacaggccgtttttatccttcccgtagtcttccatgatattgcctaaagccaagcctgaattgctcaagccgataacggtcttattgcctatttttgccccttcgagcattttatgaaaggccgcaacggcgatttcgggcaattttgaaaagccccgcccattggtttccggattgtgcaggaaataaacattttcataggtgcgttcatatcggtttttctcgggattgaaacgccccacatattgttgggcggcaaatttggcggctgcttgtatattattgaaaatgccgttgacgccgacaacgattttttcaacggttttgccggtctccgggtcggtgtaacgggcagttttcagatttttccgttcctggtcggatacttcgcgcaattcgtagatatttcccccaatggctttataggcttcccaataatctttaaatgaggcaaattcttttttcaactttactgagttgtcaaactgtttatttatatcctcttcaagctgcttatcttcaatcggctcgccgttttcatccattttaaaggtcatcaggcggtgttctgcaataaactggctgcggtaggcttcgtctgcaatgccgccgatcagcgtctcattgataaactctttggcaacatccctattgagttcgacttctttcagcaagccttcgcggtctgcttttgccaatgccttatgtgcggatgaagtgcctttttcaataccggcaatatttttcctgccctgcgcggaagcaatttgccaatctccctcactgatgacggagcgggtaatggattggcggctttctgattctttggcattgcccaacagattgcccaaacccatttttgccaaggcgtatttgtcgttgctgtgtatatcgttttgcttcaaaccgaatttcaagccgccggcgttgttttgatttaaatttgcctctttaaaggtttcccctttttcaatacgctcacttcgatatttttcgttcaactcgtcgtctttcgccgaaacctggtcaaaacgcatcaggctgaccggtttgccgccgattttaccgatttctgcttcttttttggtggaatactgtccgctggtaggcttcgggctgtatgaaaaaccgccgctcaagcccaaggcggaagcagccgccgaagcatggttttgaatatctttatgccagatttcgcttgttttcagcaggttttttgatttgtcggcatctgaaacaacagcggcgccgaccaatccggttttgccgtttacgcgaatccgatagccgtctcctcctgcaaagataccgctttgctcgttgacggatgcataatccgagctgcttttcgagcggttatagctgccaccgacactaaagccgtagcctaccgtaacttgggcggaaacattttcctgtttgcctttaaacacggcggtatcctgcaaactttcgatatgcagactctctgccgttacgccaacgcctttgcctttaagctgcccgcctttgatgacggtatcgccaccgctttcaatagcggtttggctgtctttgctgccgatatggctgttgcggtaggcggtttcgtcgccgttgccgtaacctttgccgtagtttgctccggctgtgaagccgaaactgatgcctttgttgatggcgatggcgactccggcattaaagcctgcggatttgttttcgctgcgttcctgatgcgtttggcgggcggcttcaatctgaacggcattttctgctttgaggcgtgttcctttgccgccgtacacatcggagccggtaatcgtgatgcgggagtctttgcctgcgcctgaagcagtcagggaaactttgccgccgccggtgattttgccctcttgcacctgcgtgcctttgatgcggctttcggaggtgttcttctgttcgccgtaggtaacggagacactgatgccctgaccggctgcttttttgggatttcgggcggcattatagagtgccacgccggaatctactcctttattcaaggcgttggcagcagccatggcattgacccggctgtttttgcttttgccgacggtttggactgcttttacggcgtcaaccgcgcccattacggtattcacaaccggaacgctaatggcgacggttacgcctttttgttcgtaaacctgcttactctcttggctgtaacggttttgtgcggcatcgatgctgatttttccggaggaaatgccgacatcgccttggggcgaggatatggtcgaaccggtttgggtgtaatgttttcctgccgaaatcagggtattgccgttcaggctgccgacgacgctttctgtgtggctgacggtctcggatcggttggtttgcgtgtcttttttgctgcccgccgtaaagccgatgccgccgctgcccatcagtccggatttttcttttttgttcatttcggcactgcggctgcgtgtttcggctgctttaaggacgatattgttttttgccgagagaatggtatggttgtctgcaatgatattgctgccagtaacggtaatatcgcgtcctgaaaccagaatgatttctttgccgtccagcgtgccggatacggcttgtccgttttggttcttgagatggcgggtcatcttctgtttgatgccgcccccgcttctaccggtgtatttcagggcatcttcggtttcggtatgggctttgccggcttcgactttgatatcccgtccggctgccagtttcagacggccttgttcgctgccgacctctgctgcacggatacggatgtctccttttgcattcagactgagattgccccgggtgcggatggtgctgccgacttcgttttgttctttgcgaatcacatagttgtcggaatcaaagatagtgttctgattgcgggaaatgcccgtcgtatccgagcggatgtcgccgccggcattcagtacggtttgaccgtcttcagattgattggtcaattcggaagccgtcaggacgatattgttgcctgcatccagcaagacgcttccattctgcctgccggtcagataaatgcctgccacccggccgatattgcgtaccgagccttgctcattctgattgctgcgggtctcgctgcggctttctatattgttactcgctttgagcagcagggcgttttctgcgccgatgctgccggtattcgtaatgtcgctgcctgctgcggcgaagatgtttttgccctgcaaatcaccttgcagatttttaatattctgtgcgtttaaaattagtgcttcgcgcccggcaattaagccgccccggttttcaatggcgccgctgccgatatcaacaacgctgccggacagcaacgccccttgtccgttcatatctttggggcgtgcgcggacatagactttgggtttcaatacggtttgagttgtcccgtcgggcagggtaacggtctcgttttccagccaaacaatgtcggaagtcagacgggcaacctgttcggcagacagggcaatacccggagtaagctgcaattctttggctatggtaatgccgttatccatcaaagccttgaattgctcttcgtcattggtataaccgtccaagcggcggtagcctgtcagcttggcgatttgttcgtttaccagtttctgctcgtaatagccgtcgcccaaacgcttgtggatatggttcgggtcttgttgcagtgcggcaagcatatagccgctgcccagccatttgcggtagtcggtaaaggcagggtcggtttcaatcaaatagcctttgttgtttggcgcaatggcaaacaagctgctgttcggcagagtaaatgtaggatggatgccgttttcagcaacaacgggtacaacagtgccgggtatatcagatgcctgttggggcgcatagcctttataggctgaaatacccatacggatggagctgacttcgggggccggttcgtagggagaccgactgtatcccgtagaatcccgccctttcttgtgatgacggtggtaacggtgcaagtcccctttatcggttatggtttttgttcccaaagtttcatcattgtccaatgcggattcgggcgtaccgacgatcaatctgccgccggcaataatccggctgttatgatttttcagcttggcggcatctaaaaccaaattgccgccactgatgatttgaccgggcttggattcggtaattttgctctcggcggtgattcgttcgtaatcgtatttgtaccagacagagtgggggctgccgtccggagtccgcatatgtaaagactcatcttcaaatatttcccagcccaactctttttgagaaccttccggatagcgttctgttctgccttccgcctgatattcgatacggtgttcgcgatgggtttcttccgtatggaaacgcagatgctcattggtattctgcaaatcttttgtagcgatacggatattgcctgatgattcgattgccgcactgcggttgtgcagtgatgtatttgctccttgcacctgtcggcttccattcaatgcagaaccgatatgaagatcgccggagctggacaataatgccgcctctcggttctcaatttcccgcgctccaatatccaaccgctcccgcgctgcaattaccgccgctttggtttcgccgttgaccgtttcttcccggttcaacaaggtatctgcctcaactgccacacggctgccgtaaattctgcccgtgccggcattgtccgacttggcttcggtttgcagcagcgttataccgttgctgttgattaaacccctgttggtgatgccgtttttgccgtttaacccggtgcggtttccggattggattttaccggagacagtgttgtcgatttgggcggcggtcagggatacggtatcgcctgcctgtatgatgcgggtgtttttcagacggccttgggtggagaacgtgagtgtgcgtccggcttcaatatcgcgtttgccggcaaaatcatcatgaagagaaacggaaacatcgcgtgcggcggttaatatgccgtcgttgtccagtgattttgcctgtaaggaaacatctttgcccgcaataatcgtgccgtctgtgttattgatatgcaggctgcttttgcctgtatcgcgaatatccagcaaaccggccgagccgattaagcctgcttgattatttatgccgtctgaaaccttcaatacactgcctttgccgctgcggataaagccttggcggttatcaacggtttgagcggaaatggtgatttcggcagcatcaatcgaaccgctgttgctcaatttgccgtctgcgcttaacgtaacgccgcctgttgcggcaaaaatccgacccttgttgcggattacggcgccgttgtcggtgctgattaaagtgattttgtctgcgtacatcccacccagtgtggcggtgtcgatggcaacggtaggagtaacagaatccgaagaagatggcgcagaagctgttttggcaagagagccgtcaaaatccaatttgttcttacccgaaaccaccttgacatctttaccccaaacgcccgcattgatttcagcagcacgactaaggatacgggtgtaatcggcatcagaggtatccaaacctttgcccccaatcacgactttacccgaagaaacatcaaagcccgtcagattgccgttattcaaaacaggaacgcccgaagtcagcgtaaccgaagcggcattaatcaatccgccgccattcacacggatgcccgacggattggcaacgactacttcggcgcgtttgccgccgacttcgatataaccgttcaacaacgaaggattactgctgtcaatctggttcacaattacccgcgcttcgccgcgtgccagatggggattgccttgaatccatccaccgagttgcgtttgcgtattgctgcggctgttgtttagtattacgcctttttcatcaacatcgaactgcttgaatcggttaacagaaacgccttgggatgacggagtttgaatattgacttgcggcaaaccgtttgctgtctgaagaataacggcttgttggtttttaggggcggatttgtcggcaatgatgccggaagcaggggcaggggaaaacgcagcaacacccaaagccaacatgacagaaaaggcagccatacggaaaccgaaggctgcccgggcagaagaaacagaagcggcaccggtcactcgaaccgaagccgcctcactatcctgcatactcttgccgtcacgatgaacattctctgctacagccatcatacaactgcgtttcttgttgaagataaccttgtagcatcgcttgttcatgatgggttttcttaaatgaaatgtaaggaatagttaaggacaaaatataggaaatttgaattaaattgtcaataaaaaactgacagcgtaccctgataatcagatgttgtacgctaattgtgagaagtatgtcgggatgattattttgaagttttctttttattcaaaagagttactatgaaagttaaccgggcgtaaataggcttcaataaacaggttatcgttatttttcaattgggaaaaaatcttccctaacccatccattcgccaaattattatgtgggaattcggcaatttcaataacggctgttgatccatatctgctcggtcatttagcgttataaagtcgcaaatagcgtcagaatttacaagattatcggattttgggaataaattatgccgtctgaagggctttcagacggcataggcggctaacacgggtgcggcttgcgccaaacggcgcggcaggcgcagggaatcgctttttactttggcgcggtgttccgggtttaatgatgcccgcaaccgccgtggctttccctcaaggcttccgccgcctgttcgtcggcgtggtagctggaacgtaccatcgcgccgatggcggcattgctgaagcccagttcgtatgcttctttttcaaagattttgaactgctcgggcgtaacgtagcgcaggacgggcaggtgtccgtctgaaggctggaggtactgtccgatggtaatcatttcgatattgtgcgcccgcatatcgcgcataatttcacgcacgtcttcgtctgtttcgcccaagccgaccatgatgccggatttggtcgggatgtgcggcatcatttctttataacgttttaataagtctaaagaatgttgataattggcaccgggacgggcttttctgtacaggctcggatgggtttctaggttgtggttcatcacgtcgggcggggtttcggcaaggattttgagtgcgatgtccaagcgtcctcggaagtcggggacgaggatttcgattttggtgttcgggctggtttcgcggatggctttgatgcagtcggcgaaatgctgtgcgccgccgtcgcgcaggtcgtcgcggtcgacggaggtgatgacgacgtaacgcaggttcatggctttgacggattcggcgaggtttctcggttcgtcggggtcgagcatattgggccgaccgtgtcccacgtcgcagaacgggcagcggcgggtgcagatgtcacccataatcatgaaggtcgccgtgcctttgctgaagcattcgccgatgttggggcaggaggcttcctcgcaaacggtgtgcatcttttgttcgcgcaaaatgtctttgatttcaaagaatttgcgcgatgggagtttggcgcgtatccattcgggctttttcagtttttcctgaagggggacgactttgatggggatgcgcgcggttttgtccgcgcctctgagtttgatgccgcgtttggggtcgtcggttttgatttcactcattgttgtctgctttcggtgtgaattgtgtttcaaggtgtgcggtgagtttggcggcgacttcgtccggcgtggggcagggttggacaaaatccgcgatttgcgtcatttccataccggcgtagccgcaggggttgatgtgggtaaacgggcttaaatccatattgacgttgagcgcaagcccgtgatagacggagccgtttttgatacgcagccccagtgaggcgattttgcgttctccgacataaacgccggggcgtttggggtctgccgccgcttcgatgccgtattctgccaatgtggcgatgatgctgttttcaagcgcggaaacgatgtttctaacactggttttgcgccgtttgaaatcaatcatcgtataaacgaccaattgcccgggcccgtgataggtaatctgcccgccccggtcgatttggacgacgggaatgtcgtcgcgaatcagcaggtgttcgggttttcccgccagtccttgtgtgaacacgggcgggtgttcgacgacccacagttcgtcttcggtgtcggcattccgtccggcattaaaggttttcatcgcttcaaaagtcggcagatattcgaccaaacctttgtgtatgattttcatctcaaagtaccactttgaccagttcgtgcgaagtcagcgcacggtagatgttgtccaattgttcttggttttcaacctttacctgtacggtggcgccagtatagttgcctttgctgctcggacgcgtggtgatgtggtgcgcctgcgtgtcgggggcgtggaggcggacggtgtctaaaaccgcctgctcgaactcgggatgcaccgcgcccattactttcaatgggaaggtgcagggaaattcgatgagggatgttttgtttttttgttcggtcatgatgtgctgccttgtcgtgtacggtatgccgtctgaaggcgggtttgcctttcagacggcatcggatgtgcgttattttagcctaaaccgcgataacaggctatcgggaaggcggaggcttttttgacggcgcggcggttctgctatactggcgcacaatattatttttagaagggtggtttttatgtatcggaggaaagggcggggcatcaagccgtggatgggtgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtaatgctgattatgggcttggtttacggtttgggattggtgctggtcgggctggattcggggtttgccatcggtatgcttgccggtattttggtgtttgtcccttatctcggggcgtttacgggattgctgcttgccaccgtcgccgccttgctccagttcggttcgtggaacggcatcctatcggtttgggcggtttttgccgtaggacagtttctcgaaagttttttcattacgccgaaaatcgtgggagaccgtatcgggctgtcgccgttttgggttatcttttcgctgatggcgttcgggcagctgatgggctttgtcggaatgttggcgggattgcctttggccgccgtaaccttggtcttgcttcgcgagggcgtgcagaaatattttgccggcagtttttaccggggcaggtaggcggttccgaaacatatagtggattaacaaaaatcaggacaaggcgacgaagccgcagacagtacaaatagggcaacgccgtactggtttttgttaatccactatatttgaagcggaatacaaccttgcccgggtttaaataaaaatgccgtctgaaccccgaaaactggacttcagacggcattttcatcacggcttatttggcggttttgctgctgtcgataattttcataccggcagaaatcaggctgccgatgtcggcaacattggcgggcataatcagcgtattgctttctttggcaagattgttgaacgcagcgacgtattgttccgcaatcttcagattgaccgcatccgcaccgccttgggtttgaagggcggcggcaatttgacggatggcttcggcattggcttcggcaacaaggcgcaaggattccgcttcacctttggcgcggttgatgcgggcgattttctcggcatttgacgcattgaccgcagcctgagcctcgccttcggattgttggatttcggcttcgcgctgaccactggcaaggttgatttgttcgattttacgaccttcggattcggcgatacgggcgcgtttttcgcgttcggcagtaatttgcgcctgcattgagcgaaggatttcttgcggcggaaccaagtctttaatctcataacgcaaaaccttcacaccccaagccccggccgcctcgtccaaagccgcaacaacagtactgttgatttcgtcgcgttcttcaaacgttttgtccaactccatacgcccgataacggaacgcagcgtcgtttgggcaagctgggtaatcgccataatgtagttgctcgaaccgtatgaggcgagtttggggtcggttacttggaaatagatgatgccgtcaacagtcagctgcgtattgtcgcgcgtgatgcagacctggctgggtacgtctaaagggatttctttcagcgaatggcggtaggcgacgcggtcgataaagggaatcaaaatattcaaaccggccgtcagggcgcgatggaaacgccccagcctttcgacaacgtggacttcctgttgtgggatgacaacaaaggatttgaaaccgaaaacggcgacggctaccaacaagataatgaaaaattccataattcctccgagtgttaagggtgtgtgataataagaaggttgccttccttgcggacaatgagggcgcgagttcctggttcaagctcttcttgccccgtattttgagcctgccagtgcgtaccgcgataaaaaacttcgtaacggttgccgcctgtgtgtcggaggatttcgacatattgtccggcatccaaatcctgatatgaatccgtttcaacttttctaacggcggttttggcgtgtacgaaccaaatacccagcgcggaaagcagagcggcggtcaagacggcggcaggcgtactgccggtcagcccgtaagcaatgcccgaacccgccaaagccgcgctgacaaccaaaagataaaccgttcccgtcaataattcgatgattaagacggcaacagcggcaacaaaccatacagtcatacatttccccacaaagcgcgtcgtttgacaaaataacgcaatatcagcagtatagccgaatttgaaaggatagggcagatatggacacttggcacgatgcactcggcggcgaaaaacagcagccgtattttcaggaaattttaaatgcagtcaggcaggaacgtttgtcgggacaaatcatctatccgccggcggcggatgtgttcaacgcattccgcctgacagcgttcgaccgggtcaaagccgtcattctcggacaagatccgtatcacggggcagggcaggcgcacggtttggcattttccgtccggcagggtatccgcataccgccgtctttactcaatatctacaaggagttggaaaccgacatcgaaggcttttccattcccgcgcacggctgtctgacagcgtgggcggagcagggcgtattgcttctgaacacggttttgacggtgcgtgcaggacaggcgcattcgcacgcccttttaggctgggaacgctttaccgataccgttatcaggcagcttgcgacacaccgcaagcaccttgtcttcatgttgtggggtgggtatgcacaacaaaaagggaggctgatagacagtcaaaatcatttgatattgaccgcaccgcatccgtctcctctgtcggcatatcgcggttttttcggctgccgccatttttcacaggcaaacagctatttgagccggcacggtatcgatccgataaactggaagctgtgaatgccgatatagccgttgccgccggcgtgttaaaatcgcgtttgatttgtaatttccatttattaggcaaaaccttatggcaatcaaaaaaaaatcagctttatgcatcactttgggcgggctgcgacgagttgcgcggcggtatggatgcgagcctttataaagaactatgtgcttacgctattgtttttaaaatatgtttctgataagcataagtacggcggcggcatgattgagctgcacgccggtacgacttttgacgacatcgtcaaactcaaaaacaccgccgacatcggcgaccgcctgaataagattatcgcccaaattgccgaagccaacgacttaaaaggcgtgatcgacgttaccgacttcaacgacgaagacaaactgggtaaaggtaaggagatgatcgaccgtttgagcaggcttgtcggcatttttaaaaagctcaacctttcttccaaccaagccgaagacgacgatttgttaggtgatgcctacgaatacctgatgcgccattttgcgaccgagtcaggcaaatccaaagggcagttttacacgcctgccgaagtctcccgcattatggcgaagattatcggaatcagcgcagattgccgtccagcaccagcgtttatgacccgacctgcggctcgggttcgctgttgctcaaagccgccgcccaagccggcagccaaatcagcctttacggtcaggaaaaagatgtggcaaccgcgtcccttgcccgtatgaatatgattttgcacaacaacgaaaccgccgaaatcaacaccgggaacaccttgtccgattcgtctttccgtgatgaaaacgacgggcttaagaccttcgattttgccgttgccaatccgccttatcccgcccgaaaaaaacggcgattacgcctttttgctgcatctgctcaaaagcctgaaaccaagcggcaaaggtgcgattattcttccgcacggtgtgctgtttcgcggcaatgccgaagcgcgtattcgcacggaattgcttaaccttgaccttattaaaggcattatcgggctgcctgccaacctgttttacggcacgggcattcctgcctgcatcatcgtcatcgacaaagaacacgcccaaaccgcccaatttgccgaagagggaacaaaccaagttatcagcggcggcagcgtgtttatgattgacgcatcgcgcggcttcattaaagacggcaacaaaaaccgtctgcgtgagcaagacattcacaaaatcatcgacactttcacaaacctcgttacagccgtatggtgcatttaagcgaaatcgcagcacaagattacaaccttaatctgcctcgctatatcgacagcggagaagtcgaagacctgcaaaatctcgccgcctatctatctttatggcggcatacctgcgcacgatatggacgcattggaagcctattggcaagttttaggccgtatgaaaaacgagttgtttgccgaacacgatggccactttaccactatacaacggaatcgattgcaaatctttcccactctcaacagcttaaaatcctgcgggattggtgtggaatttagggctaatctagtacagccccaaatttaatccactataaaatcgaaagcagccaaatcaaagcccatatattggcgcaccccgattacgccgccttcaaagccggacacctagcaaagtttgccgcgtggcacactcaaaacgaccttgccgccatccaaccgggcaggcttatccggaaatggagcgaaagcctgctggacgcgttcaaacccggcagcctgattgaagaatacgatttctaccaaatcctgacggactactgggcggaaaccctgcaagacgatgtttatctcatcgcccaagatggctggaaggcggttaaaaacctggccgaaatcaccaaagaaagcgatgaagccgcgaacctgaccgtcgtctttgaggaaaccgaaaccgacaaaaaaggcaaagccaaaaccaagcgcatcagcaaaaaataccgcagcgaagtcatcgcccccgagctggttgcccgccgctacttttcagacggcatcgccaagctggaagaaaaacaaagcgagctggaacgcctaagccaagaattggaaaaccacatagaagaacacggcggcgaagagggtgcgctgaacgacgtattggatgcaaaaggcaaactttccgccaaacttctgaaaaccgcattggaagaaagcggcatagaagaaggcgaacgggctgttttacaaaccacccaaacactgatgacgcaggaaaaagccgcgaaagacgcagtcaaaacccaaatcgaagccctgaaccttgccgtattcaaacaatttggccgactttccgaagccgaaatcaagcagcttgccgttcaagacaaatggcttgccgatttacaaagccgaatcgaaaatcgcttggaaaacagtattcagcagcttatcagccgcttgaacacgctggaagaccgctaccgcagcccgatggccgagcttgcccgagaagtggaaaagtggcaaagcaaagtcaatgcccaccttgaaaatatgggttttggaggctgaaatggcagcacagacaggctataaggcgagcgggttttgagacctttgcaaaattccccaaaatcccctaaattcccaccaagacatttaggggatcgcggttcgggtgtccgcaccgcttaatacgtcgtcgtccacgaactgacccatttgctcgaacgccatcgcaacgcccgttttatggcgcatatggacaactttctcccaaactggcaaagcatcaaacaacagcttaatgccttggagttatttgcacaaatatataatttaacataatatacattatgcgaactatcggaaacagttgtacgtgtccctgtggtctttccaagtaggaaaattaaagtatggccaatgcggctgaatgtatagcccggagcatccgcgtatccgaaggtactgaacgacatgccctgcatccctttcgacgcttccatccagccggtattgggaaatacgttgaccttcaatataatatacaggcagccgacacacaggatatgccgctgctttttcatcatttcttctgtcaaatccttggaacggtcgatttgaaaacacggctttacatacgccccagttccctttgcagggcttgaatattttgctgcctgtccaatacattgctttgtaatgcatttatttcttgatggttgatgttgccgccctttgccagacgtgcttgtgataacattttttgggcttcaaccaatgctttgcgttcgttgctcaattctgtttcgagaatggagcgtctgctgttgtttgagggtgcttgttgcggcggcggcgtattggattttgccggcttggatactgttttgaccggggctttatatttgacaacctgtccgccgtttgacggtgatgataccggttcgggcgtttggggcgggatatagcgttcgctgctgtagttgccgattgggggcaaatcggttgagtggcagcttttggacggcttggtggtgtaaacggtttctccgttgattgtgcaggtgtagattttggccgcattcgcacccaatgggcttgaaatcagggaaaagttgattaggattaagaggagttttgatttcataatgtgcttgattttcggataatcatttgattttttggtattttttgtaatgctttcttggcgttttacgggcttttcttttcggttggttgcttttgattttctttcggggctttggcagcctgcttgttctttttcccggcaggttttttgtttttctttttactttctatgtgtattttggcttcttaactgagttttttaattttcaggcggtatccgcctccctgatggctgctgattttaggtaaatccgcatcggcgcacaatcctgctggggctgatgtatatacgcttttgccatttgagttgcaatggtatacggaggcttgcgccgccgcgccggaaagggacaggagacccaaggcggcaaaaagtctgatgtttataccggtaaaaggcggtgataacgcccgaattataccgttattggcaggcaaagataagcaccctgcccgcgcttctttatcgctcggcaaactgtttctcgatttcagtttcaatctgttccaattcttcttggcaagccagccaaacctcttcgatttgggcaagttgtgttttgacttttgccagctcggataaggtgtcctgcaatttttctttgttttcctcgaagtaagcttcttcttgtgctaaaaatgcttcacatgccgtctgaatttcggaaagctgcgccatttctttttcggcacggtctattttctgctgtatcggcttgccgcgtcgggctttttcctgacggatttgcgcttcgatgcgcttggtgtctttgcggctttggctttgtgcggatgctgcgggcgcgacggcggcgttttcctgtgccaaacgccattggcggtagtcgttcaaatcgccgtcgaagttcttcagacggcctttatcgatcaggaggaagctgtcggtcgtggcttcaagcaggctgcgatcgtgcgatacgacgattaaggcgccttggaaactttgcagagcgagcgtcaaggcgtggcgcatatccaaatccaaatggttggtcggctcgtcaagcagcagcaggttcggcttttgccagataatcatggcaagagcgagtcgggctttttctccgccggaaaatggttcggttttctgcaacgccatatcgccgacaaaattgaagcctccgaggaaatttcggatttcttgttcgcgtacttcgggagaaagctgctgaatatgccaaacagggttttggtcggagcggatggtatcgagttggtgttgggcaaaatagccgatattgagtttttcggaacggacgatgctgccggagagtaaatcgattgtgcctgccaaagctttgataaaggtagatttaccgctgccgttgacacccaataaaccatagcgcgcgccgctttccagcgacagggtaatgtcgtgcaaaacagttttgccttcgtaacccaaatctgcgtgttctagctttaacaaaggattgggcagatggtcgggatggtaaaactcaaaggaaaactcgctgtccagatgcgcgggagcgatgcgttcgagcttcgccaaagccttcatgcggctttgcgcttgaacggctttggtggctttggctttgaagcggtcgataaaggattgcaaatgtttgatttgcgcctgctgtttgacataggcagcttgttgttgcgcgagacgctgcgcacgttcgttttggtaaaaatcgtaattgccgccgtattgcgtgagtttttgctgcgataattcaatggtttgggtagtttccgcgttgagaaaatcgcggtcatgggaaatgatgatttgcgtgcagggtaaagaagcaaggtggttttccagccacaagacggtttccaaatccaagtggttggtcggttcgtcaagcaagagcaaatcggcgcggcaaatcagggcttgcgcaagattcaggcgcatacgccagccgccggaaaaggatttgacggggcggctgtgttcttcttgcgaaaaacccagcccgttcaacaattttgccgcacgcgccggcgcggtataagcgtcgatttcttccaatttagcatgatattccgcctgcttcatgccgtcattttgcgcttctgcctgcctcaatgccgtctgaaaagcctgcaactcggcatcgccctgcaaaacgtaatccaaagcggaaatatccaaatcgggcgtttcttgggaaacggaagcgagccgccagtttttcggaatcgagacatcgccgccgtcctgagtgatttcacccttgattaaggcaaacaggctcgatttgcccgttccgtttttgccgatcaaaccgacgcgctgaccgggattgacggtagcgttggctttgtcgagcaggactttcaaaccgcgttgcagggtgaggtttttgatttcaatcataacggaaacatcgtcgggcgggaaaagcccgtattttacctgaaagtcagtgccgatgccgtctgaaacgggaaatttacggctgaagccaagcccaagccctgcgcccttccgagtgcaggaaaaccaatgtcctgaatgccgaatcggtattcatgcattccacgctgattccgattcgggaaaaatccgccatgattttgggatggataaactcctgagccgcgcccgtcccgataatcaatatttccggatagtcaacaggtttgacgtcggacaacaggttttccggagtcagatcggacaaggttcggcattgcgacaggcagaccgaatccttatgtacaagcacgggtttatggaaactttgccccgccagccggattccgcccgcaccgcattcatattccgcaaactgtccgtctatcggattttcttcaaacaacatttttttaccccgttgccgcatcatctacaccgaaagggatgcaaaatcagacaaattcatgtaggattggcagatttcatctgacccgcctgccgatttcagacggcatttgattcaaagtgcggcacaattatatcggcagcggatattttcgtctttcaatatttacatttcagtcggcttacaaggagacacaatgaagccagtaaacatcggtcttttaggtttgggtacggtcggcggcggtacggctgccgtgttgcgggacaacgcggaggaaatttcccgtcgcttggggcgcgaaatccgtatttctgccgtgtgcgatttgagtgaagaaaaagcccgacaaacctgcccgtccgcagcctttgtcaaagatccgttcgaactggtcgcacgtgaagacgtcgatgtcgtcgtcgaattgttcggcggtaccggcattgccaaagatgcggtgttgaaagccattgaaaacggcaaacacatcgttaccgccaacaaaaaactgctcgccgaatacggcaacgaaatcttcccgctggcggaaaaacaaaacgtcatcgtccaatttgaagcggcagtagcgggcggtatcccaatcatcaaagccctgcgcgaaggtttggcggcaaacaggattaaatccatcgccggcattattaacggcaccagcaacttcatcctctccgaaatgcgcgaaaaaggcagcgcgtttgccgatgtactgaaagaagcgcaggcattgggttatgccgaagccgatccgaccttcgacatcgaaggcaacgatgcgggccataaaatcaccatcatgagcgcactggcattcggcacgccgatgaacttttccgcctgctacctcgaaggcatcagcaaactcgacagccgcgacatcaaatacgccgaagaacttggctatcgcatcaaactgttgggcattacccgcaaaaccggcaaaggcatcgagctgcgcgtccaccctaccctgattcccgaaagccgcctcttggcaaacgtcaacggcgtgatgaacgccgtgcgcgtcaacgccgatatggttggcgaaaccttatattacggcgcgggcgcgggcgcattgccgaccgcttccgccgtggttgccgatatcatcgacatcgcccgcctggttgaagccgataccgcccaccgcgtaccgcatctggcgttccaacccgcgcaagtccaagcgcaaaccatcctgcctatggacgaaattaccagcagctactacctgcgcgtccaagccaaagacgaaccgggcacgctggggcaaatcgccgcgctgttggcacaagaaaacgtgtccatcgaagcactgattcaaaaaggcgtgattgatcagaccactgccgaaatcgtgattctgacccacagcacggtcgaaaaacacatcaagtcggcaatcgcagccatcgaagcactggattgcgtggaaaaaccgattaccatgatccgcatggaaagcctgcatgactgagccgaaacacgaaatgctgacgaaagagcaggttgccgcgcgcaaaaaagcaaaagccaaaatccgcaccatccgcatttgggcgtgggtcattttggcgttgctcgctttaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgcctcgccgtcgactactgcaaatgtatgtgggagcagcctttggacagattgagcgagaaacagattagatccttcggcaaactcggcgcacaagaacagcttgacctgctcggcggcgcaaatgcctttgaagcacgtgacaagcagtgtgttgccgatttgaaatcagaataatgtggaccgataaaaaagccgattctttaaagaatcggcttttttcataaaaaacggcttacagtgcgtctttcaaagctttgccggcgcggaatttaggcgttttggcggcggcaatggtcagaggctcgccggttttggggttgcggccttggcgttccgcacgttcgcccacgtagaaagtaccgaaaccgaccaaagtaacggtgtcgccttgtttcagggcggtggttactgcattggtagtggcatccaaagctttttgtgcggcggctttggaaatgtcggcttcttgagcaatcgcttcgatcaattcagacttgttcacaatcagtcccttcctgtcttaaaaaatgatgaaatgcccgaatactcggggtttgtactgcttgagcaactttcgctttatagcaattctgaaattgccgtgtcaagcaaaaaatacggaatcaccctatttgacaggctttcaggacgaaaccgcatttttacaacacatttcctgcgtttcaatgtttggttgccctgctgcggggttttggttttgaagcggattccgccgccgcttccgcaccagaaggttctgcccaaggctcaggctggctttccaaacccagagccaatacctcgtctatccatttgaccggatggatggtcaggccggttttcacgttttcagggatttcttccaagtctttgacgttgtctttcggaatcaggacgtgtttgatgccgccgcgcaaggcggccaacagtttttccttcaaaccgccgatgggcaaaacttcgccgcgcagggtaatttcgcccgtcatcgccacatcggcgcgtaccgggattttggtaaaggcagataccgccgccaaggtcatcgcaatacccgcactagggccgtctttcggcgtcgcgccttcgggaacgtggatgtggatgtcttttttctcgtaaaaatcaggagccaaacccactgattccgcacgggagcggacaaccgaccacgctgcggacacggattccttcatcacatcgcccaactggccggtgcactgaatcacgcccttacccggcaatgctgcggcttcgacggtcagcaattcgccgccgacttccgtccacgccaaaccggtaacctgcccgatacggttttcgctttcggcaacgccgtaatcgaagcggcgcacacccaaatagtcgtgcagatttttctcatttactttaaccgctttaggtttggctttgctggttttcttggtttcagacaacctcttcttatcttcgtccaaggtaatctgcatcaccaccttgcggcagattttggcaatttcgcggtcgagcgaacgcacgcccgcctctcgggtgtaataacggataatatcgcgcaccgcgctttcttcgattgccaattccccttcttttacaccgttgcgcttcatttgcttcggtacgaggtactgcatcgcgatattgattttttcgtcttcggtatagccggacagacggatgatttccatacggtcgagcaacggagtcggaatattcagactattggatgtggcgataaacatcacatcactcaaatcgtaatccacttccgcataatgatcggcaaacttgttgttttgttcgggatcgagcacttcgagcaacgcgctggcgggatcgcctcggaagtcgttacccaatttgtcgatttcgtcgagcaggaacaaggggtttttcacgccggcttttgccatattctgcaaaatcttaccgggcatagagccgatataggtgcggcggtgtcccctgatttcgctttcgtcgcgcacgccgcccaaagccatgcggacatatttccgccccgttgctttggcgatggattcgcccaaagaggttttgcccacgcccggagggccgaccaggcacagaatcgggcctttgagtttgtccatacgtttttggacggcgaggtattccaaaatccgttctttgactttttccaggccgtagtggtcggcatccagcaccagtccggctttggcgatgtctttgctgacgcgggattttttcttccacggcagctcgagcaaagtgtcgatgtagttgcgtacgacggtggattccgcagacatcggtggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttagccggctgttttcggcaatgccgttgatgctgccgataatttcggcggggatttttttattgagtttggcgtattgttcaaactgcgccaacagggtgcggcgcacggcttcgaggtcggtattgccgcccgtgtcttcttccacgaccgtctctatatgggaaacgaacagaccgcccgtgtcttcaatggtcagaacacgtccgcgatacagcccttcgaccaatacttttaccgtgccgtcgggtagtttcaacacttgcaggacttgtgcgaccgtaccggtctgatacaggtcggcggcaatcggttcttctaccgccgcatcggtttgcgccaacaggaaaaccggctcctcgcgggtaatggcgttttccagtgcggcgatggatttcggtctgccgacaaacagcggcagaaccatatgcgggtaaacgacgacatcccgcaaaggaagggttgccaaggcggcatattcctcaaaatgcttttctttttgtgtcataggtactctcttgtgtctgacagattgccgattttcgcgtacattggggttgaaggtattatttcaagcatatgtggtttatttatggagtttgatgcgatgccgtctgaaacattccggcttcagacggcatgggcttggaaagacaaggcgggaacaaaaaactgttctgtgttgccgctccttgctgtaccatccgtatggtttgcggttctgccgccctattttcaaaacatgacgcaggtatcccatgtcttcttttatttttcccgatgacgggttcgaatggcgcaacgaaagtctgcaaaagccgcccaaaggttggcattatgtccgcgaaagcggtgcagacggcattttgaaggctgcctatcaaaatattgcaactgtctagcagggcgatttccacaatgccaaacaggtgctttctgcaatgaagaagagggttcgcaaacctgccgccgtccgttccgatgcggatatcgccgcccttttccatgcccaccgtatgaagcaggcgcagcagagccgtattctgaatatgcttgccgttgaaatccgccccggttttgtgttggacaacaaacgcgcgcccgatatacgctccgctttgctcgacgtgtacggagaggcggacggcaaaccgtttttcctgccgctcaatctgctgctggggtttatgggtgcgcacgagtggcataagaaaggggttgccgttccgcagctgggcggcagcatacacgttcctttcggcgtattctcgccgttgcgcggcgaatacctcgacctgctcgcccatgcgccgtcaacgggttttcagacggcattcgatatcgggacaggctccggcgtgcttgccgccattttggcgaaacagggcattccttccgtcatcggcacggataccaatccgaaagccgtcgcctgcgcccgtgccaatattgcccgtttgggctttgaaaaacaggttgagatacgggaaaccgatctgtttcccgaagggtttgccgatctgattgtctgcaatccgccctggcttcccgccaagccgacttccgccgtcgaatccgcgttatacgaccccgaatctgcgatgctggctgcgtttttgcgggatgcgccgaaacatctgaatcccgacggagaaatccgcctgatcatttccgatcttgccgaacatctgcacctgcgtccatccgattttctggataaggcatttgctcaggcgggtttgcgtgttgccgatatgatgaaaaccaagccgaagcacaaaaaagccgcgaatccgagcgatccgcttgcttttgcgcgaacccgggaaaccactttcctataccgtttgaaaaaggcataaggggcggcggcgcggcattcgggcggattattcttgtgaaaatacccgctcgagcatactgcccaatgccgtctgacgcgttttgacggtggcggcagcttgccggaaggcttcttccccgccgaagaatacgaacttctctctcgcgcgggtaatggcggtatataacagctccttactcaatccggacaatgcatcgtccccttcgtccgaaggtgcggcggaaggcggcagcagccatacttcccggtattccgaaccttggcttttgtggacggtcatggcgaatgcgggttcaaattcgggcaggcagcttaccgctacctttttaaatccgtccgcatcggcaaaataggcggcaaggctgccctgccgtccgacatcttccataatcagtccgatgtcgccgttgaacagttcaagcgcgtagtcgttctgcctgatcataatcggctctccggcaaaatatgccaaatgttccggtatgttcattttgcggcgtacatggcggcaataggcttcgttgaagtcttccgcatcctgccgccaagctgccagaaccacgatatccgaaatgcccgcgtatgcggcttcgatattgccgtcttttaccgcctgccaataggctttgtgtgcccggtacaacctttcgactcgagcgttcggactgcattccgaatgttccagttcgtccggaaaccggtcaaacaatgcccacgccccttcatcgcccgatacggcggcacgggcaaggcagccgatgccgctgttgtcgccgaagcggtggctgaacgacagatgggcggtgttttgcgccaacacgggtggatttgcgctgacgctgaaaccgtgttccggaaggaagccggccagcctttggtgcgtttctccgtccaaaacggttttttgtgacaaaacggacagcaccgcccctattccgacggacgggagctggttttcatcccccagcagaatcacgcgcgcgccggttttgaccgcttttaaaagttgcagcatcaatgccgtatccagcatagaggcttcatcgataaccaatacgtcaaacggcagcgggtaaacagggttgaacgccgcctgcattttgggcgggcgcagcttcagcagtcggtggacggtttgcccttccagtttgagcaaatggcggcggacggcctccggcgcgtcaaaaccgttgattgcacggtgcagcgcgcgcgccatatgtgccgccgctttgcccgtcggtgcggcaagcgcgatgttgggaagattttcgtcttcaccgcaaatcagcgccagcagtttggcaaccgttgtcgttttgcccgttcccggcccgccggtaatcaccataaaagactgcaacagtgccaaggcggcggcatcgcgctgcccttcgctgcccgtgccttgaaaccattttgcgaggttttgcctcgcgcctgccgcgtcgggggcggatgtgccggctgccgccaagcgttttatctcggcagccaaatcgtattccaactgccacatcctgcccaaaaacagccttctgccttccaaaatcaaaggcgcggcggatgttccgacaacgggtgcgagtgccgacagcgcgtcagcctcgccaccgctcaaacggataaacgaatgaccgttttgcaatgcctgaaacaggcgttcggtgcagtttgcaagcacttcgtcgccggaacccgcatagtgttccaaaaaacggattgccgcccttgccgccgcttgggcaaattcatctgtctgccgttccattttattccttatccaaatgccgtctgaaggcgtggggcttcagacggcgcggtgttgtttcggctgtttaggcgtttgcgccctgtttggggtgcaggctgccgtctttcatgaccatcacgcgctcgaagcggccggcgagttcgtcgtcgtgcgttacgaccaccagccccgttcccaattctgttttcagttccagcatcatatccaaaacattcctggcgttcgcacgatcgagattgccggtcggttcgtcggcaagcaggcatttgggttgggtaaccaaggcgcgtgcaatggcggcacgctgccgctcaccgcctgaaagttcgcccgcgcggtgcgtcgaacggtgtttcagtccgaccttttccagcatcgccattgccgcctccgcagcctcttcacggctttttttgccgatcagaagcggcatcatcacattttccagtgccgaaaattcaggcagaagatggtggaactggtacacgaaaccgagatggcggttacgtaaatcgcccaaacgccgctggtttaaggtacgcaaatcctcgcccatcagcagcaccctgccttcagacggcatatccagcccgcccaaaatatgcagcagcgtcgatttgccgctgcccgaagaaccgatgatgccggtgctttcccctgcgtggatttccaaatccaagccgtgcagcacccgaacgtccaaaccgccgtcccgatagcgtttgcccacgccttcgcatttcaaaatcaactcactcataacgcaaagcctccgccggttgggtttttgacgcgcgccggctcgggtagagcgtggcaacgaaagacagtcccaaagaaatgcaggcaatcagggcaacgtcgcccatatcgacatcgctgggcaggtagtcgataaaataaacctgcgaattgatgaggtggacaccgagcaggttttcaaaaaacgccacgaccctgccgacgttccaacccaaaagcacgccgcagaccacacccgccagcgtgccgaaaaagcctgaaaacgcgccctgcaccataaaaatcttcatcacgccagcaggggaaagacccaaagtccgcaaaatcgcaatgtccgcctgcttttccgtaaccgccatcaccagggaagagacaaggttgaacgccgccacagcgataatcagcgtcaggatgatgaacatcatccgtttttccagttcgaccgcttcaaaatagctgcggttgctgtacgtccaatcgcgcacccaaaccgcgtccctttgcgcctccggaatcagtgttgccgtcaaggcgggagcgttttgcggatcggcgagcttcagccgcagccccgcaacttccttatccaaacggtacagcacgcgcgcgtcttggatatgcgtcattgccaatgagttgtccacttcgtaaacgcccgtcttaaccagaccgaccacggtaaactgtttcaacctcggtacgactccggcgggcgtaacattgccctccggcgtgatgacggtaactttattgccgacttccgcccccaaagcctccgccaagccgacaccgaggataatgtcaaactcgcccggaatcagatcttcaaatttgcctgccggcattttgtcgccgtattccaccactttgcgttcttcagacggcaaaatgccgcgcatctgcacgcccctgatttcgcccgcattggccagcaatgcctgattggaaacatagggcgcggcagccaaaatacctttgcggttttcggtaaaccgaagcaggttgcgccaatccgtatccgtattatcgatatagccgatttcggcgtgcggcgcgacattcaggagctgcccgcgtatttctttctgaaagccgttcataaccgacaagacgacaatcagcgcggttacgcccaaggcgattccggcaatcgaaaccatcgtgataaacgacataaagccgttgcgctttttcgccctgagatacctcaagcctatccaagcctctagagaaaacataacgctaccttaaaaatgtctgcaaacgtgccgccccggacggcggtttgggggcggcggcaaaagtttattgtaccgtaaaacccaggcagcgtccgaacgcccgagtgcgggggacggggcggcagagcgggcggaaaacttgcacaacgcgtcaaactgccctatcctttccttcagaaaaaccgtttcttgaggaaaacaatgaatatccgaactgcttttgctttgtgcgccatcgccttatccgccgctgcggctgcctacgccaaagaaatcaaaatcgatgccaacaacacgccttattccgaagccgacgcgcaaaagctggcggcaacggcagtcggtatgggtgttaaggaacctatcagcctgaacggcggcagcggcagcattaccgtgtccggcagcagcgcgacgcagtgcgtgttcaaagtcggcaacggaggcgcattgcagattcaagggctaaactgcaagtaaaccgcccggaaaaatgccgtctgaaggcttcagacggcattttgcattggcggcgttatgccccgccttctttaatcaggcggcgttcgtacaccgcctgcgccagcgttcccgcatcgacatattccaattcgccgcccaagggaatgccctgcgacagcctgctgactttgtaaggcaggtttttaaaaaactcggacaggacatacgccgtcgcattgccttctgcggtaaaagcggttgcaataatgatttcttcgacttccccgccgcccagccgttgcgccagcctgtccaatgcgatggcggatacgtccattcccaatgccgtattgatttgccccatcaggacgaaatacagcccgtcgtggcagtttgccgcttccatattcgacacgtcggcaggcatatgcaccaccatcagccgccgcccgtcgcgtgtttcatcggcacaaatatcgcacaatccgccttcgcaaaacgtgttgcacatcgcgcaatggtaaacctgcttcaatgccgtctgcaaggcatccaccagtttttcagcctctttgcgcttgtgttggagcaaatgatacgctatccgctgtgccgatttcggcccgacgttgggtaaaaccttcagcgcgtcgatcaatccttggaaggcatcttgttttttgtggctcatcatattccgccgtatgggaaaacggccggaatattccgaccgttattttgtcaacaaaagtgtcaattactgaccgtcgccgttgtcgaccgattgcgctcctttggtctgtttgattttgccgttgaaataacgtatcaacaagtcgaaagtattggcagactgctgttgcgccaaagcctgttttgcaagcggaagctgtgcggcgatatcatccggcggggttacagcctgtacttcgacaatcacgggtgccggcagaccgatcagcctgacgtaggcgggtttgccgtttgccggttttgctttcagcagttccgcataagcctcgggcggcatggactgccttgcctgctgtgcgcccaaaacggacacttccgaccatttcacgtcaacagccttgccgccgttcagttgggtaagcacgtcttttgccttgttttcggcaagtttggcggcttcggtacggatataagcctgacgtaccgcgtctttggcttcggcaaacggcagggttttctcttcgcggacttctttggcgcggacgacccacgcggtttcgctgttgatggtcagcacttcggaattgtgttttttcttcaatacgtcgtcgctgaatacggcattgatcaggttttcgggcataccggacatttgcgcgtcctgcctactcagccaagtttcttgggtttcgactttcaaaccgctgtttttggcggcttcggcaagcgaggaaggatggttgaacgcatcgtcgcccaatttttcttttgccttgttgaagtcggcaaccgcctttttcattttcaattcgttttcgacggcggctttttcctgctcgaaagaaggtttggcttcatttgccggcaaacgcgccacgcgctcttcaaatgcatttttcacttccgtttcactgacggtctgcttgtctgcaaaatccttcagattcaaggcgacatattccaatttgaccgcctgcggcagcagatagtcttttttgttcgcattataaaatttctgcaaatcggcttcagacactttgacttgggcgatgaactcgtcggggttgaaagtgtgcgaacggatggtgcggttgacctgtgtcagcctgatcagctgttccgcctgcgcgtcgccgaccaatacgccgttttggacgaggtttaccaaattctgcaaggcaaactgatcgcggatttcttcgacaaactggtcttcagacatatggcgttgggaaaggtagcggtttaaaagcgcgtggtcgaatttgccgtttgcgtcgtggaaattgggatcgtccacgataatttgcttgatttgttcggaagaaaccgaaatgcccatcagcttcgcgccctgtttcaggtaggcgcgttgcagcagggattggaacaccgcgtcgcgcgaagggccgccgccgtccgcctgttcgttctgtatggcgttgttgatggagtggtcgctgattttttcgtcgcccacttggacgatgtagtcggcacccggatgggataccgtgctgaccccgaagccgacgaaggttaatgcaatcaggcccaaaaggacttgggcgggcgttctgtatttttcgatggaatggaacatattttaaatcgggatatagaatgggaacgggaaattcaagtcgggtattgtaacggtttttatccctgtctgcacggggcttgccggttgaagatgccgtcgtaggtttcttcgctgaagccggcgtaaaccttgccgccgcactccaatacgggacgcttgatcaggctcggcatttcggacatcagtttgacggcctccgccgtcgaggacagcactttttgctgtgtttcggcatcgagtttgcgccagcttgtcccgcgtttgttgagcagggttgccaaaggcacttgttccagccacgagcagatttccgcttcagacggcctctgttttttaaaatcccgaaattcaaactccaagccgtatccggcaagccggtttttggcttttttgaccgtatcgcaatttgggatgccgtgaaggactatcatttggaaaccttttgtctgaaataataaaacggatattttactataagtgtctgaaaatttgcccgtctgtttcagacggcggggcggttatgttacaatccgaaaattcgaaaaatttaatctcttgttcaataaaggctttaccaatcatgatttctaccaacggcatcaccatgcagttcggcgcaaagccgctgtttgaaaacgtatccgtcaaattcggcgaaggcaaccgttacggcttgatcggcgccaacggctcaggcaaatccaccttcatgaaaatcctcggcggcgatttggaacagacggccggcgaagtggcgattgaaaacggcgtgcgtttgggtaaattgcgccaagaccagtttgcctacgaagacatgcgcgtgctggacgtggtgatgatggggcataccgaaatgtgggcggcgatgaccgaacgtgatgcgatttacgccaatcccgaagccaccgaagacgactacatgaaagccgccgaactggaagccaagttcgccgaatacgacggctacaccgccgaagcgcgtgccgccgaactgttgagcggcgtgggcatttccgaagatttgcacaatgcgaaaatggcggaagtcgccccgggcttcaaactgcgcgtattgctggcgcaggcgctgttctccaagccggatgtattgctcttggacgaaccgaccaataacttggacattaataccatccgctggttggaaggcgtgttgaaccaatacgactccacgatgattatcatcagccacgaccgccactttttgaacgaagtctgcacgcatatggcggatttggactacaacaccatcaccatctatccgggcaactacgacgactacatgctcgcctccgcccaatcgcgcgaacgcgccctgaaagacaatgccaaagccaaagagaaactgcaagagctgcaagagttcgtcgcccgcttctctgccaacaaatccaaagcccgtcaggcaaccagccgtctgaaacaggccgacaaaatcaaatcggagatggtcgaagtcaaaccttccacccgtcaaaacccgtatatccgttttgaagccgatgaaaaagccaagctgcaccgtcaggctgtggaagttgaaaaactggcgaaacgctttgaaacccagttgtttaaaaacctgaacttcatccttgaagcgggacaacgcctcgccatcatcggcccgaacggcgcgggcaaatccaccctgctgaaactcttggccggcgcgtacaaccccgaatattcagacggcctgttgccggacgaaggcaccatcaaatgggcggaaaaagccagtgtcggctactatccgcaagaccatgaaaacgacttcgacgtcgatatggacctgagcgaatggatgcgccaatgggggcaggaaggcgacgacgaacaagtcatccgcggcactttggggcgtttgctcttcggcagtaacgatgtcgtgaaaaaagtgaaggttctctccggtggtgaaaaaggccgtatgctttacggcaaactgttgctgttgaaacccaatgtcttagtcatggacgaaccgaccaaccatatggacatggaaagcatcgaatccttgaacatggcactggaaaaatacaacggcacgctgatttttgtctcccacgaccgtcagttcgtttcctccttggcaacccaaatcatcgaactggacggcaaaggcggatatgaacactacttgggcgattacgaaagttacttggagaaaaaaggcgtagcataaccgccggttggaacaatgccgtctgaagccgcttcagacggcattgttgataactttaaaataggaagcatatgcagacttatctcgtcggcggtgccgtccgcgattatcttttgggcttgcccgtcaaagaccgcgattgggtggtcgtcggcgcagacgcacaaaccatgctggcgcaaggcttccagccggtcggcaaagattttcccgtgtttctccatcccgaaacacacgaagaatacgccctcgcccgcaccgagcgcaaaaccgccaaaggttacgtcggtttcagtttccacgccgacaaagacgttacgctggagcaggatttgatgcgccgcgacctgaccatcaacgcgatggcgcaagatgcggacggcaagattatcgaccctttcggcggacaacgggatttggcggcaggcattttgcgccacgtttccccagcctttgccgaagaccccgtccgcatcctgcgtactgcccgctttgccgcgcgttacaagtttgaaatcgccgaagaaaccataaagctgatgcggcagatggtggaaaacggcgaagcggacgcattggttgccgaacgcgtctggcaggagtttgcgaaaggtttgatggaaaaaaatccgcgcaaaatgattgaagtgttgcgcgaatgcggcgcgctcaaagtcttgctgcccgaagtcaatgccctcttcggcgtgccgcaacgcgccgactaccatcccgaaatcgacagcggcatccataccctgatgacgctgcaacgcgccgccgatatgggcttgagcctgcccgaacgctatgccgccctgctgcacgacttgggcaaagccaaaacaccgtccgacatcctgccgcgccaccacggacacgacctcgccggtgtcgaacccgtgcgcgaagtcaatcagcggctgcgtgcgccgaaacattgcgccgagcttgccgaattggtttgccgttggcacattattttccaccaagtcggacagcttaaaagccaaaccattctgaacgttttgaaaaaaaccgacgctttcagacgacccgaacgctttcagacggcattgaacgtctgcattgccgacacgcaaggccgtctgaaccgcgaacacacgccctacccgcaacgcgcgcactggctcgccttactcgaagccgccaatcaggcggattcgggcaaaatcgccgccgaatgccgcgcacagggaaaagcgcaccttatcgccgaacaaatcgaccgggcgcggctggcacaaatcgccccattgcaaaaagcgtttcgagcggcgcaagacaaaacagaaaaacattaaaacgtccaatgcagccacttttatagtggattaacaaaaatcaggacaaggcgacgaagccgcagacagtacagatagtacggcaaggcgaggcaacgctgtactggtttttgttaatccactataaagttttgaggacgatacccaatccaagctttgcaacagccgccgccatatccgctataattcacgcttcagccattccgcccccgacataaaatcatgaccctgaaaaccgatttattgcctaaaatcaacaacgaagattatcaacgcctcatcctcaaacacagtgcggaatttagcggtggcgaaatccgcctgttgaacgaaatcctcgaaaaattcaatttcgacgttgttcaggcgcaggcattggcgcaagccgtcatgcagcaaatccgcttcgaccccaacgcctaccacatcgacagcgacgacgaagacaccaccggcatctgcccccactgcatcaacccgcctatgccgcccctgcgcgactatctcgtttggcgcgaaacccgcggataaaacgcttttgaccgttatcttttcaatgccgtctgaaacgccgccgaccgttcggacggcatacccgacaaagggaacactatgctgcaaaccgacaacctgaccgccgcgcaaccgcaacgcatcgttgccgcccaaaccgcctccgcacaggaagaactgctcgaacgcgccctccgccccaaaacgctggacgactacatcgggcaagacaaagccaaagaacagcttgccattttcatccaagccgccaaaaaacgcggcgaagcactcgaccacgttttgctcttcggcccgcccggactgggcaaaaccacactggcgcacatcatcgccaaagaattgggcgtaaatttgcgccaaaccagcggccccgtcctcgaacgcgcaggcgacctcgccgcccttttgaccaaccttgatccgcacgatgtattgttcatcgacgaaatccaccgcctcagccctgttgtcgaagaaatcctctatcccgcgctcgaagactaccggctcgacattatgataggcgaaggacccgccgcccgttccgtcaaaatcgacctgccgcccttcacgctcatcggcgcgaccacccgcgccggtatgctgaccaatccgttgcgcgaccgcttcggcatcgtctcccgccttgagttttacgaaaaccgagaccttaccaccatcgtcagccgttcggcacaactgttgcagctcgatatgtccgaagaaggcgcggaagaaatcgccaaacgcagccgcggtacgccgcgcatcgccaaccgcctgttgcgacgcgtgcgcgatttcgccgacgtgaaaaacaacggcacaatcgacggcggcatcgccgatgccgctttaagtatgctggacgtggacgcgcaggggctggacgtgatggacaggaaatttctcgaagccgttttgcacaaattcggcggcggcccggtcggtttggacaatgttgccgccgccatcggcgaatctacagacaccatcgaagacgttatcgaaccctaccttatccaacaaggcttcctgcaacgcaccccgcgcggcaggatggcgaccgaacgcgcctacctgcatttcgggctgcccgtcgaaaaataacgcaatgccgtctgaaacagagctaattttcagacggcatttctatttcaatcattggcgcaaggttcagcctgccgcttttttccagttccgccctcatcgcatcaatcaccgccttatagtctggtttgccgaaaatcgcagaaccggcaacaaaggtatccgcaccagctcgggcaacggcggcaatattgtcggttttgatgccgccgtccacttcgatggcgatgtgccgcccgctttgtgcttcgtaccgatccagcatcgcccgcacccggcggattttttcaagggtgtgcgggatgaagctttgtccgccgaatccggggttgaccgacatcagcaaaaccatatccagcctgtccaatacgttttccaacagatatacgggcgttgccggattcaacaccagccccgcctgacagcccatatcacgaatcaggctcaagctgcggtcgatatggcggctcgcctcgggatggaacgtgatgattgatgctcctgctttggcaaacgactgaatcaggtcgtcaacgggttcgaccatcagatgcacatcaatcggcacgcttgcataaggcttcaacgccgcgcaaaccatagggccgaaggtcaggttcggcacataatggttgtccatcacgtcaaaatggatcagatctgcacctgccgcaatgacgctttccacctcttctccgaggcgggcaaagtctgccgataaaatgctgggtgcgatacggtaagtagtcatgttttttccttcaatatccttttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttttgttaatccactatacgttccgattccgccgttatgtctgcctgccggacatacgtacgcattattaacaaaagttaaccgcgataataccatctttcacacgtcaatctagtatatttcctaaaatttccaacaagaggaaaagccgtgccactgcctgctccctgccgttttgccaaacctgccgcctcttttttaagtatggctttgctttcctgtcagctttcccacgccgccacggcttatatccccccgaacgattttcaaccgaactgcgacatacgccgactcgggctgacccaaagtcagcacaatgagctgcgtaaaatccgcaccgccttcaaaatggcgggcgacagggcgcgtttgaaggttatgcattccgaacacagccgccgccggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataatccccgaaacgctcacaacgcccgttgtttcggcagcctgcccgcccagtcgcaggcaaactgccacgcggaacgtcccgaacggctgccccgcgtctgcgcccactgcaatgccgccatctgtgcggtttcatcatacggcacgccgaaatcttccagccaattttgcaccgccgccagataatcgttttgatcgaacggataaaaactgagccacaatccgaatcggtcggacagggatattttttcttccaccgcttctttctgatggatttccccccgcatccccgtcgtaccggcattctcgtcaaaatattcgggcatcaggtgccgtctgttggaagtcgcgtaaaccaaaacgttggcgcaacgttgagacagaccgccgtctaacgcggttttcaatgccttataggtttcatcgccgctttcaaacgacaaatcgtcgcaaaatacgataaatttttccggacattccttcaaaagcgtcaacaggtaaggcaggccgattaaatcgcttttatcgacttcgatcaggcgcaatcccttatccgcatattcgtgtagcagggctttgaccagcgaggatttgcctgttccgcgcgcgccgctcatcaatacattgttcgcgggtctgccgacaatgaactgttcggtattacgcaccagcaattcggtttgcctgccgactcccgccagccttaccaagggaaaggtgtgcggatcgggcaagtgttccaaaaaaccttttttgcccgcactctgccagcggaaggcaagcgcgttccaatccgtatgcccgggttcgggcggaagcacggcatccaaacgccgcaaaacggcataggctttatcgagaaattcgttcaattccatctctgcctcactttgcatatctttgcgccatcagccgttcgacggtatcgacgattgcctgcgtattcggatcgatttcgatgttgatcctgtcgccgacctttctgctgccgaacagcgtccgttccaaagtttcgggaatcagatggacattgaaacggccgtcttcgactttgcctatggtcaggctgcaaccgtccaagccgacgaaccctttggtcaggatatagggtttgagttcatgcgggagcgaaaaccaaaccgtgcggttgaacccgtcccgttcgatttcgacaataggcacggttgccataatgtgtccgctcatgacgtgtccgccgatttcgtctccgaaacgcgccgcccgttcgatgttgacgcaatcgccttccttcagcagccccaaattggtttttgccaaagtttccgccattaaatcgaaactgacgcggtttccttcgatttcggtaatcgtcaggcagcagccgttattggcgaccgatgcgccgcgttgcagattgtccgccgcctcttgcggaagctcgacgacataagtgtgaaatgcctccgacgggcggtggattgccgtcagttttcccaatccttgaacaatgcctgtaaacataatcctgtttccctgtgtcggtaaaaatggtgcaaattgtagcatctccccgcgaaaaatgccgtctgaaatgccttcagacagcattatgcctccgattcgggcaaaaaccgcccggtatggcttgacctttcctttccacgccggtcggcggtcttgcccttatccctcctgcaaatcgatttgcgtgttcaagtcggcaaaatgcccgtcaaactcgaatctgaccggccgcgccctttgctgctgcaaccagcttcttaatgttttcatacccgaaaacagatagggaatcgcgctttgcagaatctgcgggcggatatacataatgttgtagtgcatcgttatcggcgtttccacataatacgcattgcacaacggtgtgcgtttcgacacggtttcaaacctcgccaccaaatcgtccggcagatacggcatatcgcacggcacaaccaaaagccagtcagcagccgccaactgcaaatcgttggctgcggtacacaatgccgaaagcgggccgaaatgctgccactgccgcgcatcgggaaaaatatgcggacttcttcgagcatattcttccaaattccggttggtgctgatggcgatatggctgacctgcggcctgaccctgtcgatgacatggtctatcagtgccttacccccaaaagagcaagccctttgtcctcgcctcccatacggctcgcctgaccgccggccagtatcagggcaaaagttttcattgcggatgttctcttggaaaagttcgaggttttcatgattgcagtctgccgttcccaatgactcaaaatgccgtctgaagcagacggcaaataaattcatattatctgaattttatcataacatgatttaacactgaagcggtgcggattaagttttccttaaccaattctttctgagcagttgtatctaattccaaagaatgatattgtttgcattatttggaacaatttttcgccgagcatgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggacctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcagctttatcaaaacaggcgtgcaggaatgttatgaagatgtccgcgaactgctgctcaacttccgtaccaaaatcagcaataaagaatttcccgaagccgttgccgacctattcgcccgctttacgcaacaaaccgggataacggtcgaaaccgcctgggaaaacggttcgttcctgccgcctcaggaagcgcagctccaaatgatttttatcctgcaggaaagcctgtccaacatccgcaaacacgcccgcgccacccatgtaaaattcaccctttccgaacacggcggacgctttaccatgaccatccaagacaacggacaaggtttcgacacggagaaaataggagaacccacgggcagccatgtcggactgcacatcatgcaggagcgtgccaaacgcatccatgccgttttagaaatccgttcccaagctcaacagggaaccaccgtctcattgacggttgcatctgaagaaagcttgaaatgactattaaaattattctgatagacgaccataccctcttccgcagcggcattaaagcccttttgtcgcgccaacacggttttgaagtcatcggcgaagccgcagacggcctctcgggtatcaaaatgatcagtcggctgcaacccgatgtcgtcctgcttgaccttgatatgcccggtatgaacggacgcgaagcactctcccaaatcatcagcatcaatccgcagcaggcagtgattatgctgaccgtttccgaagacagcgacgatttgaccgaatgtatgcgcatcggcgcgcgcggctacctgctgaaaaacatcaacgccgactttctgctcgaaagcatacgcaaagccgctgaaggcgataatgtattctcgcccgagatgaccgccaaactcgtcaaaagcctgatttccccccaacctgcccaagggacgcaggcactctcctcacttacccctcgtgaactggaaatcttgggctatctcgccgcaggacacagcaacaaaatcatcgcccgccacctcgatcttgccgaatccaccgtcaaagtccacgttcaaaacctgctccgcaaactcaacctcagcagccgggtgcaggccgccgtttacgccatccggcacaacgtcccccaacctgtgccggaataggcgttcagacggcatattaggggttttaatccccgtacggtcattcggataacagaccaagcatgtaagtttatgcccccataagtacgcttggcatagcagtaatattgttcggtttagtgttttccgtttgcccctatctgatactgcaatatcagctatgccgtctgaaaacgcatcatcatgatattttcagacggcataataaaaagcggaaatactaatgcagggtaaaatgttccattccgaatcccataaatatacaatggcttatatcgtttaagcatgtgtaacccaccctcatatcaatcaatatatagtggattaacaaaaaccggtacggcgttgcctcgccttgccgtactatctgtactgtctgcggcttcgtcgccttgtcctgatttttgttaatccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaaggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccctgggtcagttgcgtgtagctcatggcaatctttcttgcaggaaaggccgtatgctaccgcatactggcctttttctgttagggaaagttgcacttcaaatgcgaatccgccatcctctataaaaatgccgtccaaacccatgtttgagacggcatttcgctatagaagcaatcaggcaacctgggtttgatgctcgtctccctgacgctcacggatcaaacctaaacggtaaactgtttcaccttgttcacccaagagaccctgaaccgcatcggcatcttcggcagcaacaataacgaccatgccgatgccgcagttaaaggttcggtacatttcttgggtttccacattgcccgccttttgaagccattggaagagcttgggcaattcccacgatttagcatcgatttgtgcaaccgtgttttcaggcaacacgcgcggcacgttttcggtaatgccgccgccggtaatgtgtgccatacctttaatggtaaatttttccaaagcggcaagaatcggtttcacatacagacgggtcggcgcaataacagcctcccgcaaggttttgccattatcaaactcggcatccagatcgggattgtcgcgttcgatgattttacggataagggaatagccgtttgaatgtgcgccgttggaagccaaacccaataccacatcgcctacgccgatgctgcggccggtaatgacattctctttttccaccacgccgacggcaaaacccgccaaatcgtattctccgacgggatacatacccggcatttcggcagtttccccgccaatcagggcgcaaccggattcttcgcaaccttgggcaatgcctttaataacatcggtcgcgcgcggaacatccaatttaccgcaggcaaaatagtccaagaaaaacaagggctcagccccttgaaccaaaatatcgttgacactcattgcaacaaggtcgatgccgaccgtatcatgtttatcccaatcaaaggcaagcttgagcttggtacccacgccgtccgtaccgctgaccaatacgggattttgatatttcttgccgatttcgaccaatgcgccaaaaccgcccaaatcccccaatacttccgggcgcatcgtgcgtttggcaaacggtttgatgttttcgaccagttggtcgcctgcgtcgatatcgacacctgcatcgcggtaactcaatgaagtactcatcgtttttccttggtaaatggggattggacggtaaaataacggggcgtattctaccttatttcacgtttgcaggttcagatttttagacaatattgtaaacagtccgccatatgcccgcgcgtgtcgggtttggcgggaccgtccgcaggattaacgggcagaaacccgcctgcccttcccctcaattccttatatatcgcgttccatcaaaagacgcattgcttttcttaaccattccttttggcagacgagcggaaggggttttttgatgccatcatcaaaatcaatattttcttctttccggttgaaaccccggcattaggggtggtgaatctgattgcgtgcggaagcacccgtttccgattcggtgcggaacaaatggcggcactttatgtaccgttctgcgtgttgaaacatataggcagataaaaaagccgcccgctgaaaagcagacgacttatgttttgtggcactaatttgtcccgataagcattaactatataatttatttatcattattggtgcggacggagagactcgaactctcacacctctcggcgccagaacctaaatctggtgcgtctaccaatttcgccacgtccgcatgggaattggacgattatacagattttgtttttttgtgcaaggttttcggcggggctgttgatggcttggggtttggggcggtaaaatctgtttttcgtccgcctgacatcggaatcgggcggttttttgtttttattgacggaatttgggtatgcctgctgctttgattaaggattttctgctgactcagggtttgaagctgccgcttgacgaggttcgggcggcgtatctgacggcgcagacggtaatggatatggggacggcttcgatagaccgttcggttttgtggcgcagtgatgagggttggaaacttgccgattacctgtcgtgcgacaatgtccgcgaagatgcactgaaacggcttttcatggctttggattcggtgttttcgcgctcgacaggcgtgcggagtgcggcggtctatgccttgatgccatctgaaaaccaggctttccaactgatatgcctgtcccgacagggcgaggttttggaaaacctgtgggatttggatgaagcggcaggcaaggtttcgctggcttgccgttcggcgcaaagcggttggatgaatgttgcctcggatgtacgccgttggttggatttgggggagctttcgggagaacgcaatcatgcttcggcggcgcaaatttccattccggtctgcacggaaagtggcggtgtgttgggcgtggttcatgtggaatttgaatgcgcagagtgtgcgggtacggcagcacaggtggaatgggtggctcttgccttggctttgtccgaacctttgaaactgctgttgggtatgtctgccggaaaagatgggagtgaagatgtctgaaatgttgaaccatgtggcatcctgccgcctgccgaccgaatggggcgtatttacgatgcacggctttgaagaggcaaacgggcaggaacacgtcgcgctgaccgtcggtaatttttcagacggcaatccggttctgacgcgcatccactccgaatgcctgacgggcgatgcgctgttctcgagaaaatgcgactgcggacctcaacttgaagcggccatgagggcggtacagacagaggggcgcggcatcatcgtctatctgcgtcaggaaggacgcggcatcgggctgattaacaaaatccgcgcctatcatctgcaagaccaaggtatggatacggttgaagccaatttggcactcgggctgcccgtcgatgcccgcgatttccgtttggcgcaatctatctacgaatatctgggcatccgctcggtcaaactgctgaccaacaaccccgaaaaaatccaaaccctgaaagatgcggggattaacgtggtcgaacgcatccccctgcacgtcggggaaaaccttgaaaacaaacgctacctccaaaccaaagcagacaagctgggacatctgatgtcggaataaggcaaagttgcagggaacgggcatcctgcgccgcctttcgggaaacaggtttccataccttgataaagcaataagttttatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaatccactatataaagttacagggtgcggatgcaaacgcattgcgagcgcgggtttgaggcatacgcgcaaacatcttaatataatggattgatatttatgattttctccatcatcgtccctatttacaatgtggaaaatacctccgctgctgcgtggattccgtgcttgccgaaaattttgccgattatgaaatgattttggtcgatgacggttcgccggacggctgcgggaagatttgcgacgaatatgcaggcaaatatccgcatataaaagtgattcatcaagaaaacggcgggctgtcggatgcccgcaacgccggtatccgggcggcaaaaggcgattacctaatctttttggacagcgacgattattgggccgataccaaccgttcaaaaaacgcggggggggattctctttgatttacaacaacttgcagacaaaaaggttgatttgatcctgcatccctcgtccttcaattaccgcgacatccccaaaggggcggacttttcggataatgattttgtccgccattttgaaacgctggtggaggggcggtactatatcgccaacgcgtggacaaagattgtcaggcgggaaatcatcattaaaaacaatctgtttttcccaaaaggatacattcacgaggatttcccgtacagtttgcaattggcgcgttttatcaagacttttgccttttacgataaccctttttaccagtaccgcgttctcggcggctctatcagccacaacatcaaatacaaaaatttcagcgatgtgctgacgcatctcgactggggtgtggattttttagtcgaaaacaaaaattcccccatctacggcggtttgcaaaaatttgtcttcgacaatatcggctatctgaggtctatattggtaaggctttatttttccaaaaacattatcctcatctaccggaaatatttttcatttaaagaaaaatgcagaaagatattcggcgcgaaggcaatccgtccggtttttatcgggaagaccgcattcatcataggattgccgatattgcgcctgctcgtaccgcctatgctgtacccggcaatcaaggccgtttatcagaaatttttttcggaataagcttccggcaaaccccgaatcggaagcgggcgggaagaaacagccgccccgccggcggggattgcggcaatgccgtctgaagccacgaatccggcttcagacggcatctgtttaccaaaaagcaaataattcggtttggcgaaaaaaacagatttgctttttggtaaatacgcgattacaatccgctacatccgatttctacaaaggatgaaacgatgaccgacacagccggtctgcgccgccacaacctgcggcagtggatagaaaaatactacggcggtttgcaaactcgttttgctgaagccgttgccctcaacacaggcgaactctccgcccttttgaaaaacaaatccttcggcgagaaaaaagcccgtaaaatcgaacaggcggcaaaaatgcccgccttttggctcgataccgaacacaccgcccgcccgtccgaacacacaggaaaacacaccatgtcccatatctcccccatccccgaaatcctagccgacatcaaagccggcaaaatggtcatcatcaccgatgccgaagaccgagaaaacgaaggcgacctgctgatggcggcgcaattcgtcacgcccgaagccatcaacttcatgatcaaacacgcgcgcggcttggtctgcctgccgatggacggcgaaatggtcgaaaaactcgggctgccgatgatgacccaaaaaaacggcgcgcaatacggcaccaactttaccgtctccatcgaagccgcacacggcattaccaccggcatttccgccgccgaccgcgccctgactattcaaaccgccgtttccccgaccgctaaacccgaagacatcgtccaacccggtcatatctttccgcttcgcgcccaaaaaggcggcgtactcgtccgcgccggacacaccgaagccggcgtcgacctggcgcaaatgaacgggctgattcctgcctccgttatttgcgaaatcatcaacgacgacggcacgatggcgcgtatgcccgaactgatgaaattcgccgaagaacacaagctcaaaatcggcacgattgccgacctcatcgaataccgcagccgtaccgaaagcctgcttgaagacatgggcaatgcgcctgtacaaaccccgtggggcgagttccaacaacacgtttacgtcgacaaactctccggcgaaacccacctcgccctcgtcaaaggcacgcccgccgccgacaccgaaaccctcgtccgcgtccacgaacccttcagtgtgatggacttcattcaagccaacccgcgccattcatggtcgctgcccaaagcccttgagcacatccaacaagccgaaagcggcgtcgtcatcctcttacaccgcaccgaagacggcgcatccctgctcgaccgaaccctacccaaaggcgcaaaccaagcctacaaatgggacagcaaaagctacggcatcggcgcacaaatcctcgccggcctcaacgtcaaaaaactgcgcgtcctcgggcagccctcatctttcaccggcctgaccggcttcggtttggaagtcgtcggctttgaagaagcggaaaaataatatagtaaattcaaatactttatatttgctttatttattgcattatttccgtgcaaacgaaaacccggtctgttgggttggattttgttttttcaaatttcgggtaacttctaattcgtcattcccgcgctggcgggaatccggttcgtcgggtttttgtcatttccgataaattcctgtggctttggttttttggattctctctttcagggaaagaacggcataagtattttccaaaccaaacaaaatgccgtctgaaaggctttcagacggcattttaagtttgaccggtttcattcatcggtatttatgaattgaatttcaacatcgccaatctatccttaatctctttttccaattcggcagattcggcgaaaagtttatccaaatccgctgaaaatcccgccattttttgcgcaaattcgtcggcggaaatatccacataatcaatctttacctcgaaatactgccccgccgacaagctgtgattcttcgctttgatttcatcgtagccgattaccacactgaaatcttccactgcctgtttgtgcgtgaaggtattgcagatttttttgttcttcttcgcgggaaagtacggtttttttgccgtctttaattttttcgcccaagcccgatgcgtcgattaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttaaacttaatccactataccacgttgtctttattggctttatcaataaacaggataagacctgaaaaaaagccgatacgcctttttggtgtaccggctttgccatactgttctgcttcagacagcattgcttcattttgcctttaatacttcttcgtccagcgatttcaaccattccagcttttcgccgattttgatttccaacccgcgcgggacgggttggtagaagtccggttcgtccaagccgtcgggcatatagctttcgccggcggagtaggcgttcggttcgtcgtgggcgtagcggtattcgcgtccgtagcccaattccttcatcagcttggtcggggcgttgcgcaggtggacgggcacttcgtcgctagcgttttctttgacgaagtggcgcatttggttgtatgccttgtagcccgcgttggatttcgcggcggcggcaagatacaataccgcttgcgccaaagccagttcgccttcgggcgagcctaagcgttcgaaggtggcggcggcatcgttggcgatttggaaggcgcgcgggtcggcaagcccgatgtcttcccaagcgatacgcacgatgcggcgggcgaggtagcgcgggtcggtgccgccgtcgagcatacggcagaaccaatacagcgcggcgttcggatgcgaaccgcgcacggatttgtgcagggcggagatttggttgtagaaactctcgccgcctttgtcgaaacggcggatttgcgccccgagactgtcggcgagaaattcggcggttaagtttttcagacgacgtgtatcggcggcgcgtaaaagttgttccaacaaattcaacaatctgcgcgcatcaccgtcggcggtattcacgagtaatttttgcgcatccgtttcaatcgtaaactcttggtattcaggcaaagccaataccttggcaatcagctttttcaggtcgtctgaagacaagggttgcaaaacatacacctgagcgcggctcaacagcgcgggattgacttcaaacgacggattttccgtcgtcgcaccaataaaggttagcaaaccgctttcgacatgcggcaaaaacgcgtcctgctgcgccttgttgaagcggtggacttcatcgacaaacaaaatcgtcgcgcgtccctgctgcaaagcgatttcggctttatcgattgcctcgcggatgtccttcacgccggaaaatacggcggaaacaggcaaaaactgggcgttgaaactctgcgccaaaatccgcgccaacgtcgtcttgcccacgcccggcggcccccacagcaacatagaatgcggcttgccgccttctaccgccacgcgcaaaggtttaccttcgccgatgaggtgttcctgccccaccacgtcgtcaagcgtatgcggacgcaatcgttcggcaagcggcgcgtcgggttctcgggcaaacaaatcggtcataacggctccgtcaacaggttttcaaacaatatgattatacggcagggaacggcggcgtgccgcatacggattccgcccctccgtttgccttaagccgatattaggcgcatactggaaaagacgagagacttcacacaatatatccggcacggagaccgattccgcatcggcatgacaatacccaaatcagcgtttcaattaaacattaaggagactaaaatagaaaatttgctttatctaccattgctttgttgatttaatcggcattatgttttgaggcggaagcccatgaatatactaatattcaagagatggaatgggtgtctttattttctgatccgcaaagagacgatgatagtcttataacccttaaagatgaaaaaatcactgtaaaaaactatattgtgccttggtggaaaaaaggtgaaaactttagaaaattagaacttggcggattcgcatttgaagtgcaactttccctaacagaaaaaggccagtatgcggtagcatacggcctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccctttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagggcattttaaaatcccgaagcagacggcacgcgccccgaacattcgttctttaacgcccgttttcagaatgcccgcctgcgggcatattttgcccgatcagttcggctatcctctcgccgtcaaactgcgttttgaacaccaccttgatttctttggaaatctcggcaaacagcttttcggcatgtttgattttccgctcttcgctttttcgcaaatcttccgccccgtcagtccctttggcttcaatcacaaagttcaggatctcgccgcttttggttttcacgatataggcaaaatcgggcgaatacgtgccgccgccggcaacagggattttgatggagtttctcggtattttggtaaatacgattacgccttcaatttggttgttggcgacattttcatgttctatatccgaatcgtagaaaatctcgccgaagagatagccggcggcaggccggtgctccgtatcttcaaatctgcccaaatctgcttttttcaccgcgcgcggtttgccgtctttattggtaaatttggtcggatggattttgctgccgacaagccggtaatccagttcgaatttatggaaggaatgatgaagcaaaaaccggttgaagccgtttttgatttgggcgatggtttgcatattcaaaaaatcgccaatgttcagttcgttgcggatgcagtaaaacgcctgatgcaaagtctgcatacggatttttgccgtttgtgccagtttttccagaaactctcggtaagtcattgtgttgaaacggataaaatcttcatcttcaaaactgtctatgcggcgggaaagcataagcccgttgttgatataagcttcgtttaccgccgtgcgtatgcctgcctgtgggaatttggcagcgttttcatgcaaataggcggtaaataaatcggcaaattcggcttcatccttgattttatactgcaaaacggctttatggtgaatcagctcccacaaggctttgagttcttcatatttgccttcgcgcatgatgatggtgtctttgccttcgtctttggcgttgctgactttgcctttgtccaaacctttggggaaggcttcgggataggcggcttttaatttgtcatagccgtcttcggcaaagttttcattgtcgtcaatgatgccatctaaaaacagttggtttaccaataccagcggtttgatatcggggtatttttgcaatattttttgtttcagctcttcggtaaactttttggagatttcttcctgaaaagaattgtcgttgatttcgccgacaagctgcttcacaaagtctttttcgctgctatcgacaaaataattcagtttgtacggtacatcgcgcacccgcgccatcagctcgtttaccggcaggcgcaggccgcgtccgacttcttgcagcttggaagtcgtgctgccgctggaacgcagtttgcaaatctggaaaacgttgggattgtcccagccttcgcgcagcgtccatttggaaaaaataaagcggcgcgggttgtccaaagacagcagtttttccttatcgtgcaggatttcattgatttcctgctcgattctatcgtcgctgtctgtattgtctttggaaaaatagccgccgtggcaggcggatacatcgtccaacgtcttttgcaggtaatcgcggtaaaacgggtcgctttccgttttcagacggcgtgccgcttccgcgcgaatccagctttcaaatttatctttcaggctgcctgaaagctcgttgccgctgcggtagcccgcgatatcgtcaataaaaaacagcgtcagcggcttgattttgggctgtggcgcgcgttctgccaaaagcgcgcgttccagcttgaaatgttcggcaaccgcccgctgcatcatcgcatcctgcaccgtttgcgaataggaataagggttgatgacggcacccgttttcaactccaagccgttgcttaacaccaccacggttttattcattttgtcgattttcaaatccgaaatagccggatggatttgcgccaaatcttcgccttttgccagtttgaacgtctgctttttgtccttttcgtttaattcaaatttcgcttctttgccgtccgacgacaccagttttaccgccgcatccatgccgccctgcatttcttcctgaaacacgcgcacgcctttgaccagcccgtcgttaaacgcgtctactgccgtcaaacggtaaagcaagttgtaatattcatcgttaaatgttgcaccgtagcgcaaaatatattgcggttttaagcgtttgatattgccccacgttttcgcgctatctcgggtcgggaatttatgcggttcgtccacaatcataaacgggcgcacggcagccaatgcatcaacgggattgtcaaacaaatccttcaatgccttgtcgcccgtatcgttcatggacgacgaattaaccatgcccgcgttaatcagcagcacatgaatttcctttttgttttccgctttgacaaattgctcaatcgttatgggcgcattggactttttgcccttattctttttcgcgctttccaccacataggttttcaggcgtacgccttcataatcgccgccgaaatcctgttcaaaatgctctgccaaagccttgctttgcaaaaactgctgtgttcccgccttaatggacaaagtcggcacgaccacgataaatttgaacacgcccagccaacggtgcagctcgaacatggtttgtgtgtaggtataggttttgcccgtgcccgtttccatggaaatatcaaggatattttggtcgtccgaacggtcggggaatcggccgtctataccgttttggctttgcactttcaggatattgtttgcgtattgttttgcagcaaacaaaagttcgggattttcgtctgccgtccgatatttgggcgttgccccgtcaaacacgcccaaaaccgccgaaaccgcccgcatttggtgcggctggtttttctcgtaattaaaaccgctcatgaattgcctccgtcaaaccctgataaccacattcaactcaatctcttttttattggcataaccgcgaaccgcctggtcaagttcgtgctgcatggcgcttgccatattgctgccgaatacaatcacgcggttgggattgaaatccgcatcgtcgtccagcttgcggataaacgccaacaaatcggcggaagtaaaaccggcattcatcagatacagccgtttttcgcacagatacgccgtgtaagcccctaaccgcacaggctcaaccggcgtggtcagtgccgccccgtcatacagcgtccaggtggtcagaagcgtttgcagctgttcttcgcttaattcatcgttaagcggcaaatccggttgttcgggcgaaaaatccttgtccggatgctgcctgaaattgtctgccgtttgaaagattttgaagcccgaatcgcccgtgtaatcgggatgttcgacgcggattttggcggcggctttttctatgcgggctttggtgatgtcgaagatggtcgggtagcctgctttacgggcttcggatttttcagcggttttttcgggaagctgtacacagatatagcggcggttaccgttttgtccttcggcgttaagctgcatcacggcgtgggcggttgtgccgctgcctgcgaagaagtctaggattaggtcattactctttgaacttattgaaactaaaaatttaatcaattgactaggcttggggaaggtaaatattttgctaccaaataaatctgtgatttcttttgtgccttctttagtcattccgatattttcaggtagcgtcctactaaaaatagccaaatattcggctactgcatcggctaatgtaccaacattttcaggtaatctactgcttacagctactttgccaaaatcctcgccagcttttttcatgtcgtcatctttaaagtaacgcataactggattgctgatatttaagaaatcataatcatcagggaaaacgatttttcctttattataataatcttgaaatgtatctttggttacacgccaagttgcatttggatttgctggatatttttttcctgtcttgggatcaaccattgtgaaaaaactatttggcctttccgccgcagttgtttgtttcgttaagtcgtgggtacgccaaggacgatcggggaaatcatcagtctcataatagcgtcgttccttgcctttagttgctgcaataaattggcaagattttgcgaatacaaatatccattcataatcctgcgaaataccaaaaggcacatctgatttagctgttctttttcgccaaggcaattgtgcaacaaaattcccttccccaaacacttcatcacacaacaatttcaactgcgccgcttcgttatcgtcaatcgagataaaaatcacaccgtcgtcctttaacagttcgcgggcgacatacaggcgcggatacataaaggtgagccatgcgctgtgcgagtttgagcctttgtcggtgaaatctaaaatccgcgcggcttcgtcttcatcaatattggctaggcgggcaagttcagcgggtgtgaatttgcggtcgtcctgatagacaaagccgtctgatccggtgttttagggcgggtcgatgtaaatcatcttcacgctgtttgtgtaggcgttttttaagtgtttcaacacttctagattgtcgccacgaatcagcaggttttggctgcctgcattttcgggcttggcgttgtgcgtcttgtcttcacttatcagggtttcgggcggcaggttgcgaagcaggcgagcatatgatttgcccagccagttcatttcgtaaaattcgcgtccgatgtcggtctgcggcgcgatttcggcttgtaatctgtcgataaggaaatttccgtctgcgtcaaaacaggcgggaaacagttttttgagctgttcgagttgggtagagttggcggtaatgccgtctgaagtgtagattgcctcagtgttcgccccggctgtgtcgcttagatcagggcttgggttgggttgggttgggttgggttgggttgggttgggttgggttgggttgggttgggttgggttgggttgggttgggttggcagcattttaaaatcctcggtttgaatttgtcaatatcaactgtctgttttaaaatatttttttactttaaacggcgttttttgggaaacgggcgacgccgtctgaacgtctgtctgcgtgttactgcccgacaacaacgcgacggattttgacgggctgtacgggtacgttttgataaaagccgcgcgtggcggttttgacgcgggcgattttggaaacggtgttcatgccgctttcgaccctgccgaaaacggtatagccgtattgtccgtttttgtagtcgagcgaagcgttgtccgccagattgataaagaattggctggtggcggaatcgggggctgtcgtccgcgccatggcgatggtgccggcggtgtttttcaagccgttgccggattcgttggcaacggccttatcgcttgccttttgtgccaagtcctcggtcaatccaccgccctggataacaaaaccgtcgataacgcggtgaaaaacggtgtcgtcgtaaaagccttttcgggcatagcgcacgaaattagcaacggttttgggggctttggattcgtccaaaaccaaacggatattgcccatatcggtttccatcaaaacatgggttgccgccatagacggcagggaaaccgccaaaagcagcgcggttaaaacggttttgaatttgggtttcatcccgtcctcctcagaccttcagacagcattttcatttcctatgccgtctgaaggctcgttaacgctattccaatgcgtctttgagtttttgttcgattaaatccgcatcaaacgatttggcaatcaattcaaaacgcgagtcgcgccgccaagacacttggttcgcaccccattgcccgtccacccagttgagccacacccacgttcccaatacttggaacacgcctttggcacggacgagtccttcggtcatattgggcaaatcattgaagaagttggtcaatttttcaccgtcgaaatcgcgtccggcggggaatgtgaaaccttgcgactggaagcccatcgtgttgtccggcagggctttgaggcggtagcgtgatttttcgatgacggggatgtcaagccattggatatcgagttgtgcgttttgaacttcgaccactttagccttgggcgggaacagttttgcggctttgtcgtgaaattcggcaagctgttcgggggtgcataaatcggttttgctggcaaccaatacgtcgcagatgccgatttggtctttatacaatgcctgctgcgcgtaatcggggttgatgaactggcgcggatcgacgacggtaaagactgcgccgatttccaaaaggctgtccagcggtttggttttcagttcatcaatgacactggcggcgtgcgccagtccgcttgcttcaatcatcaggcggtcgggcttggcgtcgcgcagcattttctgcacggttacgcccatttgcgggccggcggtgcaacacaaacagccgccggcgatttctgccacagggatgccgttgtcgctcaataccgcgccgtcaatgccgatttcgccgaactcgttgacgatgatgacccatttttcgttcgggtctttttgcgccatcaggcttttgagcgcggtggttttgcctgttcccagaaaacctgaaatcaggtggactttggtttttttcatttctatgtgatgtcccactttaaaatttgaagatagggtgttttaaatgattaaataatgttaaaagtgatggcagctgttatcatgttcttcatcaattgacaattgttccagcaaattcgatatatcggctgacatcgccggtatgacgttcaaaaccgtctcccaaacgacagacaggttcatttcaaagtagccatgggcaatcctattgcgcaataccccctcatccctatccaattcaaatatttggtttcctcggcaaattccggatacgatttaaggatatgggttgcgttttcaccgataaggaacaaattaaaaacgactgcctgcacagtctttgtgtcggcagaaaattgcccataatccattttgtcggtatatagccggatatattgcgctgcctgcaatatctgtttcaaatagaccgacaattctttctgcattttcataatgcgacagcctcagtcaacaccttatctctaaagtgggccgagatgtcatcgggtgtcagcaaatcgacctttatgcccaagagtttctgcaattcctcttgcagcccgcccaaatccaataatgttgtccctgtttttgcatccaccaacaaatcaatgtcgctgttttccgtatcatctccgcgagaaaccgaaccgaatacccttggattgcaaatcaatggatatttcccgaaaactgccaatatttctttctttctgctttgcaacaaaagagacggtttcattatctgctcctttcgaaaggcttattatcaatgcaaaccaccgattactgctgacattttttacaaatcccggttaaaacaacgtgttcttctttcagcgcaaagccgctttcggcaacgcctgcgcgcagtgccgcccactcgtggctcagggtttgctcgtccgccgtgccacattcggtgcagaccaaaataaacgcgctgtggtgcgcttcggcttcttcgtggtcgtggcaatggtcgtcgcactcgtgctgcgcgtggctgcacaaaatatagccgttgaccgccgccactttgtgcaaaacgccctgctccgcccaaaaatcaagggcgcggtaggcggtaggcggtgcaagcacgccctcgctttgctgctgcatctgcgacaagacgttgtaggctttaatcacgccgctttgctgcaagacaatatctaatacctgctcgcgcaaagcggttacctgcaagccttcgctgcgtgcctgttcgataattttctgtttgaaatttgttttcataaattctctgtttatgccgtctgaacaaccgatacggcaggaggcggttttatatttgtattcaattgctttatttggaaatcttttccaacaatgcccgacagcccgcatccgcaagcctgaaggtttcttcaaaatcgcccgtataccacggatcggggacatggtcgtaaccgctttcgggtatcaggtcggtcagcttgaatattttttccggccgcctgccgaaggttctttccaattcggacaaattcttgccgtccatcgcgatgatgcagtcaaacgccgccgcatcgctttggcggattttgcggctggtaaagcctgaagcatcgataccgtgttttttcaatatctttgccgtctcgcggtgcatatcttcgccgtcgtgccagcccgatgtccccgcgctgtccgcttcaaggggaatgcccgcttcggcggcgcggcggcgcaaaatgtattccgccatcggcgaacggcagatgttgccgaggcagacaaaaaggattttcggttttttcatatcccctccctgttccggcgcgatgccgtctgaagcggaaaccctttcagacggcatcggtcggttaatcgtaaccgcataaggcagaaccagccaaaacatccatctggaagaaatggtttggctaaatcttaggcatatttaataagtgtccaatattagaagccgtatgctccaaatagaggctggcatttttcaaactatcttctaaaggttcacttttctccaaaatagaaaaggcagcttggatattttcaaatggcagggaaggcaaatcttcaacgagactgccacaaatagcgacaacaggaactccgacaggggttctttttgctacaccaataggcgctttccctgctaaactttgacgatctagtcttccttcaccaacgataaccaagtcaacatctgacactttcttatcaaagtcaatcaagtccaggcaggtgtcaattccagatacgatacttgcctgagcaaaggcgcacaaaccaccagcgatgcctccaccagctcctgctcctttaagttttaatgttgcaggggagactttttcataaaaatcttgtattgcctgatctacggcctcaaacatagtagaatccaaccctttttgcttgccaaacgtataggtcgcaccttggtgtccacataagggactcacaacatctgctaaaatacgaatgtgaacatcttcaggaatttcatagcgattttctgttgaaacagaagctaggtttagtaaggattgaccgcaaacgggtaaggcatttccatcctcatcataaaattgataacctaaaccagcagcaatcccaatacctccatcattactggccgtaccgccaacgccaatatagatttctttaatttcttgactaatgaggtggcgaatcaattctccaataccacgagtttggatttgtaatggatttcgtttctctagcgggatttttccaagaccaaccaaatcagcaacttcgaatagggctagttgttctttttgaaaatagcgcatgacttctttttgtccaaaaggtcctgtcacttggagacatttttcttctaggtcaagagaatgtcggatagcatctacagtgccttctcccccatcaccgacaggacagaggagacattccacatctgctatcgattgttggaagcctctttttattgcttcagctacctgttgagctgtcaagctttccttaaacgaatccggtgcaattacaatcttcatatttataattcatcctttcgtttcactcaaggcacaacacagaatgaaaaagtgttgtgctctttattttgatttattatataaatgagaaagcctatcactactacaaatcactatgcgctgaaaaacggattgtgcccttcccgtttcaatgcttccgcatagctcgggatgctttcctgttcgcccaagggattgtgcaacaggtaaacgtgttccacgcggcactccgccatcaggtcgaggaaattttgctggatgacggcgatgttgtcggtaaaggaaagctgccacgaaaacacctgcggcacgacttcaaacgcgccgtcggtcgcattaaacccgaataaaatctgtccgcccgcctttgccgcagcgaccacgccgacgcgcggactctgcatacggacggcgcgtatcgcgtttgccgcaaacacatccatcgccatacgttggcgcgtgtggctgccgtctgaaagcgcgcgtaccggagaatccggggaaagcggattggcaaacagcgtaacgccttccgatgcaagattttcctgccatacctgcatcaggggcagacctgcctgaagaaggttctgacccaatgccgtctgaactttgccgctgccgaaacccagcgcgtaaacgacgtggacggactgcccttcgggcaacagcaaagggcgcggggcgaaacggcgcaagtgttgcgccgccgcttcggtattttgtttggcacgccaccactcatccggcgcgaccgcgctcaaatcggaagaatgcacaagataaggcagccattgcgtctcttgcgtcaacgcgcgcaggtgcggatagttttgcaggcaggcaaacaatgcctccgtcggcagcttcatctcgattgcacgttcttttttgcagccggacaccagcacgaccggcagggcgaaccactgcacttcgccttctttctcgcaatcgagtaccgcgttcacactggaaagcagcgcggcataagttccggcatcgggcgacatcgtcagcgcgagggaaaggttgatatagtggttttgctcaagcattcccctgatttcggtttgaagttggccggacgagagtttgcgcgaagcctgggaagaattatgcgccaactggtaggcattgagcagcaggtggtttttaatcggattttggggatacgggcgcgtatcgggcaaggtaaatgtctggttcatatgtgtcgtgcaccgcttttcgcagtgtgtgtctttcctgtctgaaaatatatcggacggattgccgccgggacttgcccgtcaatccgccgaaacgagaaaatgcctgtctgccaagtctgccaatatttcttccacatacacttcggcaggcggatggaatgtcaaaccgtcgggcgtggtgctgacgatgttcaagttttcggcaaccgtttcaatcaatgcctgtttgctcgtcggccgcgacaattggcgcataatgtacaaatgcccgtatccgaatgagggggtgctttcgttgtaacggttggcaggccggacaaacgcttccgcgccgtgttccacaaaggcggcggcatagtttgtaaagcgcgccggcacataggttttatggtcttcaaaaaatggtttgcccgcattgtctgatgaaacagaaaaacgcccgagaatggtttgcaataaaagctgggaattgattttcatgcggtcaaattccaaaccgggaaatcggcgggcgagattttccgcaacatcttccgttttaaacgcctctccggttttcatcacatcgcgtatgcccgaaagcaggatatcgttttcatcaaagttgattgtttcccctcttgccgggcggaaattcaaactttctatcacttcgacggcaaccgactcatcacgcctgacagtatccccgacttcctcacggcataaaagcgaacggcggaattggcggtcggataaaatatcactgtaaaattctttggcaatataatcgtcccctgccaatgccagaatccgctcccgcgtatgctccgccatccaagaaacaaaagacacgtgcaaattggtatccccgatatatgcgagcctgtggcggttagcccattcgatgaagccgttgacgtaaatcgggtcgttaaacgcctccatatattcgtgtgcgatgtaataaaaattatgattcaatattttttgaatcgccggaagtttgccgccgccgtccaagcccttgtcgttttccaaaatttccgccagcgccttgagcgcgtccaagcctttccgcgtccgcgcttccaagggttcttcaagcacatccctgccggcaaagtacataatttcgcgcaactgctcctgccgtttccagccggggtaaacattgtatgaaatataggcaatgccgtgtttggtcaggttgttccagcaaatcgaaaaaattttgtctttaactgcgtcaggcacccacgaccaaatgccgtggacgatgatatagtcaaacttcccgaatgactcatcgatggtcaaaatatctttttcttccagacgcacatttttcaagcccattttttcaatgatggcgttgccctgtgcaacctgcctgccggacaggtcgataccgacaaattccgcatccgggtaataaagtgcctgcgtgatgatgtttccgcccatcgaacagcccagctccaagaccttggcattggcggcgggcgcgggctgcaaacccatcaggcgggcgcgcgcctccaaattattgatggcggtttgagagaatgcgccggattcgtacatcaaatcatcatatgaatttttgatgttggacacgtccggcacaccgttctccgttgcagcacgcgcaaaggcggcttttttcttcttgttcggcatattttgtttgtctgaaggcactattgcccgcaagtttaaccaattcatcctacccgttcaactaaatcaaatgccatctgaaggcgcggagcgtacttcagacggcatctgggaggcgcgaaggcttcagacggcatttttgccgctttatttcaacgcggcatcatagccgccgtcttcaacggcttcaatcaacgcccctgcatcggtttgcgcggggtcgtatccgacggtcgcacttttgttttcaaggctgacttcgacgcttgccacgccttttacgccttccaatatccgggtaacgcttttgacgcagccgccgcagctcatgccgccgatgtcgaggataagggtttccatgatttttcctttcgttggtactgcattctgacgggcgttattgtaagtcggggcgtgaacttgggcaaacgcggaaacggtgcggcggtttgaaaaaatacggacgcttgcgcataatggcggcaattcccatcaggacaacaacaatgaacgcttcgcaaaaaccctggttgagcatcattgccttggcaatcggcgcatttatagtggattaacaaaaaccagtacgtcgttgcctcgccttagctcaaagagaacgattctctaaggtgctgaagcaccaagtgaatcggttccgtactatttgtactgtctgcggcttcgttgccttgtcctgatttttgttaatccactatacaacgtcggtatcggcggcggcgcgctgctggggcattgggttacgcaatactcgggcatttcctgcatcggcgttgcgggtatgctgacggcggcggcaggtttgtgggtctgcctgaacctgaaccgccatatccgaacctgaccgcacgatgccgtctgaagcccctcccgcccttcagacggcattttgattgaagaaatatccacccctgcttaaaataacgggctttgccgtgttttaacgcctattttttgttccaaggatggtttatgccgctgctgtctgtcgagttcgcactgttctttctcgccttcctgccgatttactggggcttggcgaaatacccgtccgtccaaaacctgctgcttttggctgccggtatgggctggctctaccatatcggccctgtatttgcggcaatcatcgtcctttattcctcctgcgtgtaccttttgggcgaactgctccgttccgatcgcgaaaatacgcgccgtttctggctggggtgcggcattgccgcctcgctgaccgtcttgggctttttcaaatatttcgactttttccgcccgatgattgcccaatatgccggaaaaggcggcgcaatcgacatcctgatgccgctggggctttcgtattacaccttccagtcgctcgcctatctggtttactgcttccgcgccccgcacgccgcgcgtttcagctggcacgagctgctgctgcacctgagttttttccccaccgttacctccggcccgattatccgcgccgccgcattcaaaagcgcagacggcgagcaggcaggcgcattggcgcaaatccgtacccgccgagcgcgttcgcccgtccgccccgcactcgccgtttccctgattctgctgggtattgccaaaaaatggtggctggcggggatgctggcggaaaactgggtgtcgcccgtatttgaaaatcccgcccaattcgacggctggggcgtattgggcggcgtgtacggctataccttccaactctttttagacttttccggatattccgatttggttatcggcatggcgatgctgctgggctttaggctgcccaaaaatttctccgcaccgcttcgtgctttaaacatccgcgcattttgggacaaatggcacatcagcctttccacctggatacgcgactacatctacatccccttgggcggcagcaaaaaaggctttttacggacacagctcaacctgatggcggcaatggtgctctcaggcatctggcacggctacggctggaacttcctcatttggggcgcgctgcacggcacggcactggtgctgctcaacacgggcgaccgctatttcggacgcgacgcgctatgccgtctgaaatacttcgcgccgctctcatggctcattaccttccatttcgtctgccttagctttgtcgtcttcaataccgcaaatcccgacgatgcaggcgcagttttcagtgccctctttgccaatgccaacggctggaatgcgccgcaacaggcaaacatgctgttgcttgcctcgtttgcatccgtgatgctgctctacccttacctgcaacgcgctttcgacggcgcggtcaaaggtttggaaaaaatcccgatgtggctgtggtttatccccgtttccgccgtcctgctgctgattatcgtcctcgccccctcggggatacccggctttatttatgccaatttttaagggtttggacatgaaaaactttctttcccttttctcctccatactgatgtctgccctgattgccgtgtggttcagccaaaaccccatcaacgcctactggcagcagacctaccaccgcaacagcccgctcgaaccgcttgccgcctacggatggtggcggagcggtgcggcgttgcaagaaaacgcctacgccctttcagacggcatcaaagccttcctgtccggcgaaacgccgccgacggctcaagacggcggttcggcagatatgccgtctgaagccgccgcatccgaagccgtccctcaaaccggtgaaacagaatggaaacaagacaccgaagccgccgccgtccgcagcggcgacaaagtcttttttgtcggcgactcgctgatgcagggcgttgcccccttcgtgcaaaaaagcctgaaacagcaatacggcatcgaatccgtcaacctcagcaaacaaagcacggggctgtcctacccctcattcttcgactggccgaaaacgattgaagaaaccctgcaaaaacatcccgaaatcagcgtactcgccgtcttcctcggaccgaacgacccgtgggatttccccgtcggcaaactctatctcaaattcgcttccgacgaatgggcgcaagaatacctgaaacgtgtcgaccgcatccttgaagccgcacacacgcaccgcgtccaagtcgtctggctcggcatcccctacatgaaaaaagccaagctcgacggacagatgcgctacctagacaaactgctttcggaacatttgaaaggcaaaatcatcctgattcccaccacgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatgaaccccaaacacctcatcgcattttccgccctattcgccgccacgcaggcagaagccctacctgtcgcctccgtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctgcaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgacctcgcccaaaccggcgccgatttggttatcctttcctacggcaccaacgaagctttcaacaacaacatcgacattgccgacaccgaacaaaaatggctggataccgtccgccaaatccgcgacagcctgcctgccgccggcatcctcatcatcggcgcacccgaatccctgaaaaacacgctcggcgtatgcggcacacgccccgtccgcctgaccgaagtccaacagatgcagcggcgcgtcgcccgtcaggggcagacgatgttctggtcttggcaaaacgccatgggcggcatatgcagcatgaaaaactggctcaaccaaggatgggccgccaaagacggcgtacacttctccgccaaaggctaccggcgcgcggcggaaatgctcgccgacagcctcgaagaactcgtccgctccgctgcaatcaggcaataatcggacaggaggcggacggtatttccgcaacagggggatgccgtctgaaacgcataccttcatattgcttcagacggcatagccaccccgcgcacggtttgccggacgcaaccggcattcgcctcaggcatcggaaggacgcaggcgaacctccggcatacggcgcaaaggcggcgtttgatatgccgtctgaaggcaaagatgataaactgccgccttccgttttcagacggcatattgttttcaaatgagggcgttctccgtccgcaaccataaaggaagtttcatgaaccggacttatgccaatttctacgaaatgctcgccgccgcctgccgcaaaaacggaaacggcacggcagtgttcgacggcaaggaaaaaaccgcctaccgcgcgctcaagcaggaggccgaagccgtcgcggcgtatctgcaaaatatcggcgtgaagttcggcgacacggtcgcgctggcggtttccaattccacagaatttattaccgcctatttcgccatctccgccatcggcgcggtcgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacggacaaaagccgtccgaccggcgaaacggcggaaggcgatgccttttttgaagacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaagcgcgaccgctttatcgttttcctgccgatgttccacagcttcacgctgacggctatggtgctgctgccgatttatatggcgtgttcgattattttggtcaaatccgtttttccgttttccaacgttttgaaacagacactgctcaaacgcgcgaccgtgtttttgggcgtacccgcgatttacaccgcgatgagcaaggcgaaaatcccttggtatttcagatggttcaaccgcattcgcctgtttatcagcggcggcgcgcctttggcggaacaaaccatcctcgatttcaaagccaagttcccccgcgccaaattgctggaaggctacggactgagcgaagcctctcccgtcgtcgccgtcaatacgcccgagaggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgagattgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatgaacgccgtgccgtccgaagccccgtccggcaaaaaaatgcggtgaatctgattcaccgcatttttttgacaaacaccggagggagggcatttactctgccaattccacctgctcgtgcgccatcagttcctgaccgacatcatccaacaacatcaaataacgttcgtagtttttcaaaatgtcggcaatcagctcgtccttgttcatatactgcacatcgtacccgacgcgcccgtcgaaaaaataagcgtagggtttgtaagttgtctgatgccggatatgcggcagcttgccgtcgttaatcaactggtcggatacatcctgcccgacagacttaatcccgtacataaaatcgcgcatcgtctctttccgaatgacgaactcgattgcgggctcgtcccgatgaaacattttatcgacccggacgctcaagccgtattcttccgaaagctcccgttgcaactcgtgcatagcgggcgatgcagtctgtttgaggaattttaaaatatcctgctcctgcgtctggctcattatctgcaccagccgttctttccacttgccgcccgtccaaaatacactggtagggttaacccgggtctcaaaatatttcttatccgcactcaagcctttccacaggctgaaacacattatcagcatcagcagggcaaacggcagggaaacaatcagggtcatagactgcaggttgccgagtccgcccgagcgcatcagcaaaacggcaacggcagacatcagcacgccccacataaccgcctgccaccgtggcgcgctcaagcctttgtcccgagaggtaatattgttcaggacataaatcccggaatcggcagaagttacaaaaaacagagaaatgaccagcaggctgacgatgctcgtcaattcgggcagggggaggtaattaaagaatttaaaaagcagcgtttccggagaggaggtcatcttttcgagcattccccccgcaaccccgtcattcagccaaatcgccgtattgccgaagacggtaaaccacaaaacgccgaacaggccggggatgagcaaaaccccgaagacaaactcgcggatggtgcgcccctttgaaatgcgcgcgataaacaaacccacaaacggcgcccaagaacaccaccacgcccaataaagcaccgtccaagattcaaaccacggcttgtgttcccgttcgtacgcataagttttaaaactgaggcgcaccagatttccgaggtagttccctatgttgtcgccgaatgccgacaacaggtaaacagtgggtcccgccgccaaaacaaaaaacagcagcaaaaacgcaaggcccaggttcaactcgctcaacaccttcacgcccttccccacgccggatattgccgaaacgacggcgagggacatgacggcggcgataatcaaaacctgcacgctgaagctgttttcggcaatccagcccatttcctgcaatccggcgcccagttgcgaagccccgaaccccaatgtggtgatgatgccgaaaaaagtagcaagcaacgccataatatcaatggcatcgccgaaccttccggaaattttttctttcaacagggggtaaaaacaagaacgcagggcaagcggcagcttgtagcggaaaccgaaataagccaaagccaatgcaatcgtaccgtacaccgaccaagcgtgaacgccccaatggaacaccgtgtgcagcaatgcctgctgctgcctgtgttccggcgtgccggccgtaatgtccgaaaaataatgcatcaacggctctgccacgccgaaaaacatcagacccacgcccatcccggccgcaaacagcatcgccagccacgacaggaagccgaattccggcacatcttcatcccgtccgagcctgatgtttcccaaactgctgaccgagagtatcagcaggaaacccagaaaaatggaaaacgttaaaacataaaaccagctgaactcggtaaaaatgacttcttttgcccgatcgagccacatctgcacctgatccggcacggttaaaaccaataccaccaaaacacacacaaaaaacaaagtcgtcaaaataaccatcggattaaatgacgttcggcgttctataaattcagacagggacaaaccttctcactcctttgttaaaaacagacaaacccggtcatcgggcaaagcggtcaaaacctgccggtaaaataccggcttccggatgacgaaatgcacaaaccggccgaaattgttataatcgaaaaaattaaaaatcaatacggattattctatcagattgatttatcgatatttattatatcattaatatagtttgatttcaaaccggcggaaaatgcgccgcccaccgcaggcgcgccctccccgctatcggggcgtttaacgccggattgccgatgcggtacaatggctgatatgaagaaaattacccctcaaaacctgcgccccctgctttcggaaagcttgggacataccgattttgtcaacgtcctcaacgcactgattaaatttttgcgccgtggcggcaaaaaatgtgcgggggaacgtttcgacctgattatcgacacattcaaacaagacagggaattactgtcccgcttcagccggtgtttttacatttggctcgcgcaaatacacatttatccggcactcatcaaactcggcatcttctcgcgccacagctttgcccgggaaatgggcatacgcatctacgaacgcttcagcccgtcatataaagattttgccaacttgggcgaagtcttcctttatcttttccattccgaaaacgacgacaaatggctgcaaacgctcaatatccgccaatggctggttttatacgaactcatccggagccacgccgagccgtccaaattgcagacggcgggcatccgccttgccgatgcgcgtttgcgcgccatcgaaatgctgtctgtctggacggcatccgaagccatcgaacccgacctcatccgcatcgccccgcgcctgctggaagccgattcttccttcgtcgccctccaacgcgaaaccgccaaactggtcgaacactaccgcaacggcaccacgccttacgacaccgcccacctcgaagtgatgttcgaccaatgtttcagccagattgactatttgcgccgcaaagggacgggcgccggctccggttcgtcggtcaaagtcgcccacctgctcgaacggctccggcagaccgtagaccgtctgaagctgctcaccgacatccaaaccggcgccggcaacagcaaccgcctgaccatcgcgctgatgaactccctcatctacgcggcggtcgaacaatacagcacccgccacctgcgccgcagcagcatccgtatgctcgcccgcagcattaccgaaaacaaaagccaccacggcgaacactacatcacccgcaaccgcaaagaatatttcaaaatgttctactcggcggcaggcggcggcatcatcatcgccctaatggcgctgctcaaaatccgcatcggctcactcggcctcagccccttcctcacttccttgtcggctgggttcaactacggcatcggctttatgatcatccatatgctgcactgcaccgtcgccaccaagcagcccgcgatgactgccgccagctttgccgaacaggtcgatctcaacgaaggcggcaaagcggtggacaacaaactcgccaagctcctcatcgacgtatgccgctcccaaagtgtcgccgtcttcggcaacgtttccatcgccatccttttggcgtgcgccatatcgttcggctatgcccatctgtaccggctgcccatactcgatgcccacaccgccgcctaccagttcaaatccatagacatcatcgcttacccgacgctgtggtatgccgccattgcaggtctgtggctgttctgctccggcatcatcgcaggttttttcgacaaccgcgccgactacctcaacctgcgccaacgcctgcccttcaaccccttgctgcgtaaaatcatgcgccccgggccccgccgcgtcctcgccgcctacatccacaaacactacggctcgctggtcggcaacttcatcttcgggatgctcttgggtatgaccggctatttcggacacctcctcgggctgccgctggacatccgccacgtcgccttttcctccgccaacctcggctatgccgccgtcagcggcaacgtcggtttgggcacgttcgtactcggcattttcagcgtcctcgccatcggcctggtcaacctctgcgtcagcttcagcctcgccctcttcgtcgccctgcgctcgcgcggcacgaaaatcggcagcatccgcaatctgattaaaagtttttggaatcagattaaaagcaatccctgcatacttttcctcccgcccgccaaagaacagggacatcctccttcggacaagccttgaccggcaatgccgtctgaagcgggattcgccccgaataccgccctgatgcgggaaatccccataaaaggatgcaaaaatgccgtccgaaccgaaacgtggttcagacggcattttaaaaaacattacaatcccgggccgccaagcgaattggcaatgtccctgaccgccgttacatacatccggctgtggttgtactgccataccgtataaaaattgttcaagcccaaataatattcaaacacgcccggtgcggtttccagtttgaacaaaaccgccttttcatcatctgcaagctcttcgccggggatgatgccgtacgccttcaaatccgccaccgtccgcgtcagggcggttttttcgccaatgattgcctgaacatccgcacccggcgccaatgttgcagacaccagcattttcccgcccgtgcgccaaccgtgctgcttcatataattggcaaccgatgccgcgacatcgccgacgttgccccatatgtcccgatgtccgtccccgtcataatccaccgcccatttccggtagctcgaaggcataaattgcggcatccccattgcgcccgcatagctgcctttaaaggcgaaaacatcgccgccttcttcttttgccagctttaaaagctcgaccaattctttttggaaaaacccggcgcggcgggggtaatcaaagcctaaggtcgccaatgcgtccgccacacggaaactgcccgtatttttgccgtaattcgtttcaatcccgataaccgccacgataagttcggcaggcacgccgtatttttgcgccacatcatcgataagcgcgcggttttccgcataaaaccggcgcgcgccgcgaaatttcgccttgcccgaatttcccgtgcggaacacataccacggacgcgatgtggaggggcggtgcataatcttgacgatgtccgccttgtaagccgctttgtcaaaaaaatcctgccattccgcccgggaaaaatcccctttcccgacttcatcgtccacaaaacggcggacatttgcattggcggcaaacccgctgtcggataccggtacggctgccgcgtcaaatacggctgccgcgtcaaacgcggggcggctttcttttttcatttcaaccgcgcggggggcttgggcttcatttgcccggggtgggcgtgcctccatcgccgtacaggcagacaaagccgccaaacaaattgccagcggcagtatttttctctttttcataaatatgttccgaacaaatagggtaagtgggaaagcggcacaagggggcggcgcgaaatgcggcatccgccgcaatcggcggctttgcggaatgccgcacgttgcctcttgcaccgcccgaaatccgtatgtcgtcgccgaaaatgccgtctgaaggcacttcccctttcagacggcattgcctgccgccgtatttgcccgctacccgcaatatcggcagtccaatatatctttgcggatgtcgttcagcaggaaggctgcggtgtcttcgtgtttcgcctgtacgaagacaaagagtcgggcgatgattttgccgataaagactttttgcagggcgcaggcatcggtcagggtgtgttcctgcaggaagctgcggatgtcttcaggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcacccaagagtttttgcaacatttgcgcggcggcgtaagtgtattccgtggcgagggttttgacgatgttcgcctccatcagctgatgggcgacgggggcaacaggcgaaacggaatggcagacgtagcggtaaagaatctcggaaacctgatggcggcgccggatttcgcggcgttcgtaatcgacgaatttgatgtcgttgcggacgtatcgttccagattttcaaggatgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcgatatattcgtagtaggactgcatttcgcgtgcaatcgccgcgccggaggtttcgggttcggtaacacccaaaccgccgccctcgcctttgaaaatcatctccaaaccttgcgcgacttgcgcttcatcgccgaactcttgcagtggctgcaacaccagcgcgccttcgatgccggtacgcagcgtaacgggcacgccgtaatgccccgcaatccgcaggacttcttggatttcaaactggctgcccttgcgcccgccgtattttttgtcgaggaagggcaacagcaaacccgcctgcttcaaggcaagccatttgtcttcgggcaggtatcgcatcaggtcgataccgtctgaaaaaatgcggcggaatgcggattcgatgtgctttaaaaaagcagccgtgtccatagttgacggctgcgcgctcggttcggtgtgtatcatcggcttcctctgtcggttcccattaatcggcggccggtcaaaccgcctgccacagtttagagttgattttctaaactttaccacaaagtgcgccgggcaacaatccgccgacctttcagacggcatcgcgtcccctcccgtgctaaaatgaccgtttgcatcactgtccgccgattgccgcactatgacctaccccatccccaaaccccgtgaaaaatcccgttggcccaatctttcgcaaggctcgctgcccttggctttggcgcgttatctgccgcacaagcggctcaaggtcgtgctgacccaagatgcggaacaggcgttgcgccttcagacggcatggcggtttttccgtccgcacgacacggcggtgttcctgccggactgggaaacgctgccttacgagcgtttttcgccgcatcaggatttggtgtcggagcggctgtcggcgttgtggcagattaaaagcggcgcggcggatgtgttgttcgtgccggttgccacggcgatgcagaagctgccgcccgtgccgtttctggcagggcgcacgttttggctgaaaacggggcagactttggatataggccgtctgaaaagtgatttggtggatgcgggctacaaccatgtttcccacgttgtcgcggcgggcgaatttgccgtgcgcggcggtatagtcgatttgttcccgatgggcagcgaaatgccgtaccgcatcgatttgtttgacgatgaaatcgacagcatcaaaaccttcgataccgaaacgcaacgcaccatttcccccgtttccgaaatccgcctgctgccggcgcacgagttccccaccgacagcgaggcgcaaaaaatcttccgcagccgcttccgcgaggaagtcgatggtaatccgaacgatgcggctgtgtacaaagccgtcagcaacggtcatttcggcgcgggcgtggaatactacctgccgctgttttttgaaaacgagttggaaacgctgtttgactatatcggcgaagatgcgctgtttgtctctttagacgatgttcatgccgaggcaaaccgtttttggagcgatgtcaaatcgcgttacgcgatggcgcagggcgacgaaacctatccgcctttgcttccacagtatttgtatctctctgccgatgtgttcgcaggccgtctgaaaaactacggacaggtgctgcccgatgtttccggcaaggaatacaccctgcccgaccttgccgtcaaccgccaagcagatgagccgttgcaggcattgaaggattttcagacggcgtttgacggacggattttgctgtgcgccgaaagtttgggacggcgcgaaactatgctcggtttcttgcagcaaaacggtttgaaagccaaacccgtgtccgactggcagggctttttatcggcacacgagccgctgatgattacagtggcgccgttggcatacgggttcaaactgggcggactgcaatcgccgaaccaacagcaacctactccctcccccgtgggggagggttggggagagggcaaagcagttgccgctcaaactgaattttccgcagccgcaataaaccctctccctagccctctcccacaggagagggaacaaagtgcagccgccgtttcagacagtctgaaagcagccgccgtttcaaccgaaagcagcctgcccctcggtacaagtaatctgcacgggcaaatccgacagcaacctgccccttcccccgtgggggagggttggggagagggcaaagcagttgccgctcaaaccgaatttcccgcatccgcaacaaaccctctccctagccctctcccacaggagagggaacaaagtgcagccgccgtttcagacgacctgaaaaccaaaagcagcctgcatcccgtcgcaaataatctgcacgggcaaatccgacagcaacctactccctcccccgtgggggagggttggggagagggcaaagcagttgccgctcaaaccgaattttccgcagccgcaacaaaccctctccctagccctctcccacaggagagggaacaaagtgcagccgtcgtttcagacagtctgaaagcagccgccgtttcaaccgaaagcagcctgccccccggtaaaagtaatctgcacgggcaaatccaacagcaacctgccccctcccccgtgggggagggttggggagagggcaaagcagttgccgctcaaagtgccatcgccgtcatcaccgaatccgatctctaccaatacgtcgcccgttcgcgcatccacaaccgccgcaagaaacacgccgccgtttcagacgggctgttgcgcgaccttgccgaaatcaatatcggcgaccccgtcgtgcacgaagaacacggcatcgggcggtatatgggcttggtaacgatggacttgggcggcgaaaccaacgaaatgatgttgctcgaatacgcaggcgaagcgcagctttatgtgcctgtttcgcaactgcatttaatcagccgctactccggtcaggcgcatgaaaacattgccctgcacaagctcggcagtggcgcgtggaacaaggcgaagcgcaaagccgccgaaaaagcgcgcgacaccgccgccgaattgctcaacctctacgcccaacgcgccgcccaatcgggacacaagtttgaaatcaacgagttggactatcaggcgtttgccgacggcttcggctacgaggaaaccgaagaccaggccgccgccatcgccgccgtgattaaagatttgacgcaagcgaagccgatggatcgccttgtgtgcggcgatgtcggcttcggcaaaaccgaagtcgccctgcgcgccgcgtttgtggcggtgatgggcggcaaacaggtcgccgtacttgctccgaccacgcttttggtcgagcagcacgcgcaaaacttcgccgaccgtttcgccgatttccccgtgaaagtcgccagcctttcgcgtttcaacaacagcaaagccaccaaagccgcgctggaaggcatggcagacggcacggtcgatattgttatcggtacgcacaaactggtgcaggacgacatcaaattcaaaaacttaggtttagtgattatcgacgaagaacaccgcttcggcgtgcgtcagaaagagcagctcaaacgcctgcgcgccaatgttgatatccttaccatgaccgccacgccgattccgcgtactttaagtatggcgttggaaggactgcgcgacttctcgctgattaccaccgcgcccagccgccgcctcgccgtcaaaacctttgtcaaaccctttagcgaaggcagcgtgcgcgaagccgtgttgcgcgaactcaaacgcggaggacaggtatttttcctgcacaatgaagtagatacgattgaaaatatgcgcgagcggctggaaaccctgctgcccgaagcccgcatcggcgtggcgcacggacaactgcgcgagcgcgagctggaacaagtcatgcgcgactttttgcagcaacgatttaacgtgttgctctgttccaccatcatcgaaaccggtatcgatatccccaacgccaacaccatcatcatcaaccgcgccgacaaattcggactggcgcaactgcaccagcttcgcgggcgcgtcggccgcagccatcaccaagcctacgcctacctgctcacgcccgaatacatcactaaagacgcagaaaaacgcctcgatgccattgcggcggcagacgaactcggcgcaggttttaccctagccatgcaggatttggaaatccgtggtgcaggcgaaatccttggcgaaggacaatccggcgaaatgatacaggtcggcttcacgctctacaccgaaatgctcaaacaagccgttcgcgacctcaaaaaaggccgccagcccgacctcgacgcaccgttgggcatcaccaccgaaatcaaactgcacagccccgccctgctgcccgaagattactgccccgacatccacgaacggctcgtcctctacaaacgcctcgccgtctgcgaaaccgtgcaacaaatcaacaccatacacgaagaactcgtcgaccgcttcggcctgcccgaacaacccgtcaaaacccttatcgaaagccaccacttacggcttatggcaaaagaattgggtatcgatgccattgatgcggccggcgaagcggtaacggtaacctttggtaaaaacaataatgtcgatccaaccgaaatcatcctgctgattcagaacgacaaaaaataccgccttgccggcgccgataagctgcggtttaccgcagagatggaaaatatcgaggtcagaatcaacaccgtaaaaaacgttttaaaaaccttgcaaaacagatgcctgcccaaataaagccgacaccgcaatgccgtctgaaacaccgttttccttgtccgaaagccgccattatgaatttgaaggaaactccactataatacggcattcagatttccagacggcatcgcgcccgtcaaaccgcacacaaaccaaaaggaaatacatgttccgtaccatgcttggcggaaaaatccaccgcgccaccgttaccgaagccgatttgaactatgtcggcagtattaccgtcgatcaagacctgttagacgcggcaggcatctaccccaacgaaaaagtcgccattgtcaacaacaacaacggcgaacgttttgaaacctataccattgcagggaaacgcggcagcggcgtgatttgtctgaacggtgctgcagccaggctggtacagaaaggcgatatcgtcatcatcatgtcttacgtccaactctccgaacccgaaatcgccgcacacgaacccaaagtcgtcttggtagacggaaacaacaaaatccgcgacatcatctcctacgagccgccgcacaccgtgctgtaattccgcaaacggacatcgattatggatattaaaatcaacgacatcaccctcggcaacaactcgcccttcgtcctattcggcggcatcaacgttttggaaagcttggattccaccctccaaacctgcgcgcattacgtcgaagttacccgaaaactcggtattccctatatctttaaagcctctttcgacaaggcaaaccgttcctccatccattcttatcgcggcgtaggcttggaagaaggcttaaagatttttgaaaaagtcaaagcagagttcggcatccccgtcattaccgacgtacacgaaccccatcagtgccaacccgtcgccgaagtgtgcgatgtcatccagcttcccgcctttcttgcgcggcagaccgatttagtggttgccatggcaaaaactggcaacgtcgtcaacatcaaaaaacctcagttcctcagcccctctcaaatgaaaaacattgtggaaaaattccacgaagccggcaacgggaaactgattttatgcgaacgcggcagcagcttcggctacgacaacctcgttgtcgatatgctcggtttcggcgtgatgaaacagacttgcggcaacctgccggttattttcgacgttacccattccctgcaaacccgcgatgccggttctgccgcatccggcggtcgtcgcgcacaggctttggatttggcacttgcaggcatggcaacccgccttgccggtctgttcctcgaatcgcaccccgatccgaaactggcaaaatgcgacggccccagcgcgctgccgctgcaccttttagaagattttttaatccgcatcaaagcattggacgatttaatcaaatcacaaccgattttaacaatcgagtaacacggtttcgccttatgatgcagactttccgaaaaatcagccggtatgtcgcaaccttgtggctcggtatgcagattatggcgggttatatcgccgcaccggtgctgttcaaaatgctgcccaaaatgcaggcgggcgaaattgccggcgtattgttcgacatcctctcttggagcgggcttgccgtttggggcgcggtactggctgccgcctttgccgccctaacccggcggcaaaccgccctgctgctttttttattgtccgcccttgccgccaaccgattcttgattacacccgttatcgaggcactgaaatacggacatgaaaattggctgttgtcgtttgtaggcggatccttcggaatgtggcacggcatttccagtattgtttttatggcaaccgccctactttcagcagttttaagttggcggctttccggcaaagatgccgtctgaagccctcccatttttttacctcccttcacttcacttggagaacattcatgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataaaaaaggttaaggtatgaagtgggtaactgtcgttttatccttcgcacttgtctgttgccaatacagcctctggttcggcaaaggcagcatcggacgcaacagcagtctgagagaacagattgccgttcaagaagaaaaaaaccagacactcgccctacgcaatcattcccttgccgccgaagtctatgatttggaaaacggtcaagaagccatttcggaaatcgcccgggtagaactgggttatatccaagacggtgaaaccttttaccgactcatcaggcataaccggtaataccgtcaaaaagccgtccgaaccaatgttcggacggcttttatttcaacaaactgtcagacagcccctcatcctcccccgacaaaccgcaatccagcctgacatccccctcgacgcaacagcagcacggcagtatctcgtcccgccccaaaaaagccaaaggcggctcccgataagtaacgcttccctccaaaatcttcactcggcacgatccgcaatatccgcttcggcactgatattccaccatatgccccgtccgttccaagccttccaacagagtctcgccctccaagagttcaaaaaaacccttattcgtaccaatgcgcgccatttccgaccaatcaaaaatatagtggattaaatttaaaccagtacggcgttgcctcgccttgccgtactatttgtactgtctgcggcttcgtcgccttgtccggatttttgttaatccactataatccactataatccactataaaaggaacaataaccgatcctacccgctgtttttcccatcatacaacatacaaatgccgtctgaaacatccggcttcagacggcattttttcaaaaaacatttacaactcaaaatcgcccaaatcatccgtattcacttcagaatctatctgaccgatcaaataagaggatatttccacttcctgcggcgcgacctgtacgttgtcggacgacagccacgcattaatccacggaatcgggttttgatttgcgccttcaaatccggccggcaaccccaccgcctgcatacgcagattggtaatatattcgacgtattgggataagatttctttgttcaaaccaatcatcgaaccgtctttaaacaaatatgccgcccattctttttcctgttccgccgcttttttgaagagttggaaacattcgtcctgcaactcggcggcaatttctgccatttcagaatcatcaacaccagaacgcatcagattaagcatatgctgcgtgccggtcaggtgcagggcttcgtcgcgggcaatcagtttgatgattttggcgttgccttccatcaactcgcgctcggcaaaagcaaacgagcaggcgaatgaaacgtagaaacggatggcttccaacacgttgacgcacatcaggcagagatagagttttttcttcaacccgcgcaaagacacggtaacgggtttgccgccgacattgtgcaccccttcgcccaacaggttgtaatactgggtgtattcgattaagtcatcgtaatagcaggcaatgtcttcggcgcgggcggtaatgtattcgttttcgacaatatcatcaaacacgaccgacggatcattcacaatattgcggatgatgtgggtatagctgcgcgagtgtatggtttcgctgaagctccacgtttcaatccacgtttccaactcgggaatcgaaaccaaaggcagcaaggcaacattcggactgcgcccttggatggaatcgagcagtgtttggtatttcagattgctgatgaaaatatgtttttcgtgttcgggcagattggcgtagtcgatacggtcgcgcgagacatcgatttcttcaggccgccagaagaaagacaattgtttttcaatcagtttttcaaatacttcgtatttctgctggtcataacgggcaacattaaccggctgaccaaaaaacatcggctcattcagcgcgtcgtttttggttttgggaaaggtgctgtatgacatagttaagtgttcgcaggacataatctattctctatattaattaaaaatgatctgtaagttttaactaacctgctgagactttatatatttaataaaattttctaaagttaaaacatgggttttcccaaaagttccaaatgtttttacggattctttagggacaactaaggttaaattctcatcactcatttcctgaatttgagtatcagatataccttcttgtagagtaaataaatgcttatgaggaattcgatctgcttcatttaaaacttggcgccagcgatccttacaagtagtctttgaacctagcattgtcagcttttcagtttgaaatatgaaattccctgattcatccatcgcatggtactcttcacttccaggaaataaaaaatctggtttctttttcccttctgtcttcgcttgcgtctcaaattttaaggaaaattcgtcaaatattcttgataaatgtaactctaaagattttcctgctcttgcttttctgcgatttgtaaaagaatgtgcaaaattaatgaagctatccaaatcagtaatttttgatttaataatttcaaattcacgtttttcaaaaatggaaaataattcatattcctttgaaacccattgttttaacacattactaacgttagttttatttaatgcaatattttcccttgccaaaactgccatttcttcagttttggggaagttaggaaatagtgaaaataattttgttaggttatcctctacttcttgttttttaggtaaatataaacttcctggtaaaatgttagtttctgcgataaatatttcaatatcttcatctgaagataaaacaaaagcatggaataataaatctttataacaagctctgcacaataccaataaggaaccactatatttatcacttaaaaattcaaaattcttgccaaaacccgtaattctcgcctcatttctcgtgccttggccgtaatatttaaaattgctattagtgacgcttccatcttgccaattaattttgattgaaatagttttatttgttcccttttggcaaactacatcaaagaggtcgtctgaaaaatgtttttgaatataaaatcctgattggtgactaccagtagtaccaacatcattgggacgaatataacgacagtatactgcaattgatttatttgctgtctgtattgctgaagctactaagtcatcggatttatttactacttgtattgtctgagctgccaagtcattcattttttaactcatttataatttgtttagcaatagcttgaaccaacggtacagcaattgaattgccaaactgcttgtatgcagctgtcttggatactgcatcaataacaaaatctttaggaaatcccattaaacgcgagcactccctaggtgtcagcttcctaggattttttcctttctgagggatgagtatttcggaaccatctttgtaatatcgtgcagatagagttcgtgatattccatctaaatcaactaatccaaaaccaaatccattaccctttgccttatgttttttagcgtaattttgaaggtaaagccataagttatcagaaagagtaaaagaattatctacatcatcttccaaaatttgctttaattttggttgtgattctggtggggaaggaaaattgaaatttatttccttattaaaatattgtctatcaaaacctacaataaaaatacgctccctattttgaggaacataatattttgcattcataacttgataaaatatctgatagtcaagctcttctaaagtccctttaattactttaaatgtatttcctttgtcatgcgaaacaaggtttttcacattctctaaaagaaaaattttaggtcgatgttttccaataatttcagcaacatcaaaaaatagagttccctgcgccttatctaagaagcctgtttctcgtcctaggctttttttctttgaaacaccagctatagagaatggctgacacgggaatcctgctgttaatacatcaaacttacttggaatagctgctttggtttcctttaatgtaatatctccataaggaatatcattaaaatttacttggtaggtttgacgggctttatcatcccattcactagaaaatacacatcgcccaccaacattctccattgcaatgcgaaaaccacctattcccgcaaataaatcaataaaagtaaatttctcattatttaaggtaactatattatctaattgattttgtattttatttttcatattttatatttcagatgatttattaatctaaaggccatctgaaaactccccctttcatcaaatcttacaagccccgcccgcgcagccgtcatcctgaatatcggtctgcgtatcgtccgcaccgtcgcgggtgttatggtagtacagggttttgacgccgtatttgtaggcggtcagcaggtctttgagcatttgtttcatagaaactttgccgccttcgaatttgcccgggtcgtaggcggtattggcggaaatcgattgatcgacgaatttttgcatcacgccgacaagtttcaggtagccttcgttgccgggaagctgccacagggtttcataggcatttttcagggtttcaaactccggcacgacttgtttcaaaatgccgtctttcgatgctttgaccgttaccaatccgcgcggcggctcgatgccgttggtggcgttggcgatttgagagctggtttcagacggcatgagcgcggtcagagtagagttgcgcaggccgtatttgacgatttcggcacgcaggctttcccagtcgtaatgcaaaggctcgccgcagacggcatccaaatcttttttgtaagtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggaaccgtcgctgtagcggacaccgtttttcgccagataataagcatagttaatcacgccgatgccgagcgaacggcggcccatagtagaggtacgcgcggcttctaccggatatccctgataatctaaaagtgcatcgagcgcacgaacggtcaagtcggcaagcccttccaattcgtccaagctgtttaatgcgcccaagttaaaggcagacagtgtacacagggcgatttcgccgttcggatcgttgatattgtccagcggtttggtcggcagggcgatttccatacacaagttggactgatgaacaggcgcgacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacaccgcggttgtttttcaacaccagcaggctttcggcttcgatatgccacaaggggtagaacaaggttgccgcgccgccgcgcacgccgccttgcgaacaggatttgaccgccgcctgaaacattttaaagaagggaatgcagccggtatgccgcgcttcgccgccccggatttcgctgtccaaaccgcggatacgtccggcattgatgccgatgcccgcacgctgggaaacgtatttcacaatcgcgctggtagtggcattgatggaatccaaactatcgtcgcattcaatcagcacacagcttgagaactggcgcgtaggcgtacgcacgccgctcataatcggagtcggcagcgatactttaaatgtagaaacggcatcgtaaaaccgtttgacgtaacccaagcgcgcctctttcgggtatttgctgaaaaggcacatcgccaccaaaacatataaaaactgcggcgtttcgtaaatttggcgggtaacgcggttctgtaccagatatttgccttcgagctgtttgacagcggcataggaaaaggacatatcgcgttcgtggtcgatataggcgttcagttcgtcaaattcttcgcggctgtaatcctcaaggatatgcctgtcgtattttccggcatcggtaagttttttaacgtggtcgtaaaggtgcggcggctcgtactcgccgtaggctattttacgaagatggaaaatcgccaaacgcgcggcaaggtattggtagtccggggtatcttccgaaattaaatcggcagcggctttgatgatggtttcgtggatgtcgtcggtgcggatgccgttgtagaactggatgtgcgatttcaactcgacctgcgacacggaaacattttccaatccgtccgccgcccaagtgacgacacggtgaatcttatccaaatcaatggcttctaatcttccgtctcgtttggttactttcaaatcagtcggtgtattcatcgcttcctcttccactcttgatattcaagacacagtcttttcaaataaattaaggcagacaatatagtggatttttggcattttctccagtcttgacaacggttgtatttttcagtttcaggcaatgcgcgataaaacccgcctgtcgtatttttcctataatatttgttttatctgataattctttaccgataaaaaacgggtaaattttttgccttttgaccggctccggctacaaggcggtgaaataaggattttccgacgaaaaaggaaagcttcctgttttctgcccctgcaaattgttaaattttgcaaagtatgattttgccgcgccgccgccgacaaattccattttcttaccgattggaatttattattgagattaatgtgttatttgaatctgcatatcaaacggcaagttttgtcggctgaatgagtctgaaactgccgacaatttgcccgttccatccttccatcctatactggaaagaatgacaaactgaaaggatcgtcatgtctgtcaaaaagatgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttatgcggaacagaaaatccaatgccgggcggcttatgaggctttcgatgatttcgacggcggcagtttccgccgttaatcccatataaaatatgccgtctgaacacaggttcagacggcattttccatagatacaacaaactatccttacgccatttcgtttgaggtcctcccgttgccgcagccttaatatagtggattaacaaaaatcaggacaaggcgacgaagccgcagacagtacagatagtacgaaaccgattcacttggtgcttcagcaccttagagaatcgttctctttgagctaaggcgaggcaacgctgtactggtttttgttaatccactatacatccacaaaagcgaatcatactgccacattccgacaaccggtttcagacagcgatatccgcatcgtcggcgacaacggcacggatgctttcttcgattttatcttttaaagcataacggtcttcgctttccgccgcatccgccacgcaaacgaaatcgactcttatcgtcaattttttcatagacacgatgcgccacaggcaggtcggcaaaccgacatcggcatatgagggacgagccgtcctttttcccgtttcgtcataataacgcagcgcgaccgccaaaacctttgcccccgcatcgatggcggattggaacagcgcggctttgaacggcaaaagccccaatccggaggaagtccgcgcttcggggaaaaaactgacgttttgaccgcgttgcaaggtttcgcagacggcgcggttaatcggttcgatgtcgcgccgcgaattgcggttgatgaacaccgttcccgcgttctgccccatcttgcccaataccggccagcttttgatttcctgcttggcgataaagctgctcggataaaccgcgctcatcgcgaaaatatccagccaggacacgtggttggcggcaaccaagacaccgttcggatgttcgggtgcgggtctgcccacctccaatccgatatccaaagccgccaaaacccccctgcccaactcgattaccgcccgattgcgcgactcggggcaaccgccgtcaataccgcgcaggtttttcccggttttgaacagccagaccgccaaacggcacaagcggcgcagacgtgtaaaaaatgaagctttatttgaagacatgagcaattctttcccgataatcggtgtttgttgttgaaacgttcggacggcataccgataaaatgccgtctgaaaccgttttcagtcctatttctgacagttcgggcaataaaacgtgccgcgctgccccaaagtttctttcacaaccaaaccgccgcaccgggggcacggctgattgtgccgcccgtacactgtatattcctgttggaagtagccgcttttgccgtcgctgtccacaaaatccctcaaggtactgccgcccgtttcaatggcgcgctgcaacaccgctttgacggtttcaaccaaaagcgcgcactctttctttttcaggcggttggcaggacggtggggcgaaatgcccgctctgaacaggctctcgttggcataaatgttgcccacaccgaccacgaccgcattgtccatcagggcaagtttgaccgcgcgcttctgcgccttcagccttgcatacagataatccgcacaaaatgcctccgacaaaggctccggccccagtttttccaacagcggatgatgttcttcgattccctcataccaaagtatcgcgccgaactttctcggatcgcggtaacgcatgaccgtgccgtctgaaaacacaatatcgacgtgatcgtgtctgtccggcctgccgatacgtccgtccgacggcgtaaaaatccgcaagctgcccgacatccccaagtgaatcagcagcacgcccgtttgaaagcggataagcaggtatttcgccctcctgccgcaggacaacacctgccggccggacaaaatctcccccaaatcgggattaatctgccagcgcagcttcaattggcgcaataccacggcttccaccgttttcccttcaatatgcggcgcgatgccgcgcaacgtcgtttccacttccggcaattcaggcataacccctcccgacatttcttctgacagatgccgtctgaaagacggctgtccctaatccgcaacccttgccgcacccgccgcaagggctttgccgcccaaatacccgtcccacgcgggcaggggcgttacgcccgctgcccttttgaccaaaaccaaaccgtacactgcggcacactgcggccaccaacggtcgcccgccttttccataaaccgccaaaagcgtatttgcccgagcgacgaaaccggcggcagatacaccataaatttcccaaattcaatatcgaaaccgacatccgcaagccgtcttttcaactcgggcagcggcagacaaaaccgtttttccggcaggcgttcgccgtcaaaccaacggctgaatccccagagcgaatacggattgaaacccgtcagcatcaagcgtccgcacggtttcaatatccggtgcgcttccgacaggatttgcgaaggaacaccgccttcaagcgtatgcggaaaaagcagcatatccgcagaaacatccgccaaagccatattctccgccgacatcgacatatctcgcggcacacagacaacatcttcagacaggctcagccacggaccgcccacctgaaccgcacacattcccgaaaaacggtatgaatccagataccgcccgaagaaatcctgttccaattttgcaacataccgccccatcgccgtatcttcaaaccatgcatccatattgcgtccgtttcaaacagattgcctgccgatattctattccaaacaggatttctgtcaaaaaacacatcggccgcccatttccgaatccgcataaagttcctgtaaaacttgacgctttttcagtcaaacagtaccatcggacgataaaatatgtttattccgccgaatataaatcatgtccaaactcaaaaccatcgctctgaccgcatcaggtctgtccgtttgtccgggtttcctatacgcccaaaacacctcatcacaccaaatcggtttggcgattatgcgcttaaactcttcaatactcgacctgcccccgacaaaacaatatttccaatccggcagcctgtggggcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcaggattatggcagtttatgcccgctaccggcaggcattacggcctggaaaaaacaccggtttacgacggcaggcacgacgtttacgccgccaccgatgccgcactcaactatctgcaatacctctatggactgttcggcgactggccgcttgcctttgccgcctacaactggggtgaaggcaacgtcggacgcgccatcaaccgcgcccgcgcccaagggctcgaaccgacctacgaaaacctgcgtatgcccaacgaaacgcgcaactatgtccccaagctgctcgccgtgcgcaacattattgccactccccaatctttcggcatgaatatcagcgacatagacaacaaaccctattttcaggcagtcgaaccggatcgtccgctcgacaacgaagccatcgcccggcttgccggcatcacgcaaagcgagctgctcgccctaaaccccgcattcaacgtccccgcgtttatccccaaaagcaaacgcaaactgctgcttcctgtcgcgtccgtacaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccgacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctgaaacccaaaccgcaacactcgcgcagatcatcccccaaaacgacatgcaggcggcagacgaactcatgcagcttgttgcccgaaacaacctgcgccgacaggctgaagaaaccatctccgccgtcatcggcacgcctgacacagttgccgaacacaaaatttccgcatctccgcaacataccgctgccgccgacggcaaacgccgggtacgtttggaaacgcgcgtagccaaagctgccgacggcgaagccgaaatctccccgctccatgccagcatccaccgcgttgtagaaggcgacaccctgttcaacattgccaaacgctacaacgtcagtgtagccgacctgattgtcgccaacaacatcaaaggcaacaccatccaaaaaggacaggtactccgcctggcgcaggcagcccctgcccaaacccgtattgaaaaagtatcctacaccgcgcgcaaaggcgacaccttcaaaagtatcgccgcgcgcttcaatatccatatcgacgacatccgccggctcaatcccaacctgaacaccatcaatccgggacagagggtcaaactgattggaagctgattcggatacggcacatgacaggactttctcagtcctgtctttttcatcccacatttcccataccatcatgaaacttatcaaatacctgcaatatcaaggcataggaagccgcaagcagtgccaatggctgattgccggcggttatgttttcatcaacggaacctgcatggacgacaccgatgcagacatcgattcctcatccgtcgaaacgttggatattgacggggaagcagtaaccgtcgttcccgaaccctatttctacatcatgctcaacaagcctgaagattacgaaacttcgcacaaacccaagcactaccgcagcgtattcagcctgttccccgacaatatgcggaacatcgatatgcaggcggtcggcaggctggatgcagatacgaccggcgtattgctgattaccaacgacggcaaactgaaccacagcctgacttcgccgagcagaaaaattcccaagctgtacgaagtaacgctcaaacaccccacaggagaaacgctctgcgaaaccttgaaaaacggcgtgctgctccacgacgaaaacgaaaccgtttgtgccgccgatgccgttttgaaaaacccgaccaccctgctgctgaccattaccgaaggaaaataccaccaagtcaaacgcatgatcgccgccgccggcaaccgcgtgcaacaccttcatcgccggcgattcgcacatctggaaacagaaaacctcaaacccggggaatggaaatttatcgaatgtccaaaattctgaaataacatccaagaattccatttatattcatccacatactcattaaatatatggtttaacccaatttaacgcaaaaaatcaatttacgatataatccatttgtctgagtaacgcctgttcaagcaggcttatgagtaagacgttttccccgtaatgtgttttgccatctatacttctccccttgtatagatggtttttttatagtggattaaatttaaaccagtacagcgttgcctcgccttgccgtactatttgtactgtctgcggcttcgtcgccttgtcctgatttttgttaatccactatatttcaaattccctctctttcatcattatttaaatgctatcattaatataattaacaaaatttcatttccatacaccgatgtagaagaataacaaattaatctatttataaactccgattcttcctcatcgggttatactcatcagaaatactcactgaaatatatgccttttacatggaaaatcactagacagttgaaaagcaatcagtcagttcctgttaaaaaacgcgtgtagaatttccgctttatctcaatcggacacggtttcaatatgtcttccccttcaaataccaatcgtcaaacctggtccagccgattaacctatatcctgaccgttgccggcgcgactgtcggtttcggcgcgacgtggcgtttcccgtatttggtcggtgaaaacggtggtgcgcgtatgtgtttttattctgtatcgcgatgctggttatcggcatcccgatgattttggtggaaaatgtcatcggacggcgcaaaggcgtgaacgcgctggatgcgttcggcggcccgatgaacggcaaacccattgccaaaatttggaaactggtcggctggatgggctgctcggcgcgttcggcatcatggcttattacatggtactcggcggctgggtaatcagctatatcgttaatattattggaggaaatttgaatatttccagccccgtcgacggtgtggttacaaaaggcttctttgccgaacacattgaaacagcccttgggaaattgcgttttatacgctgctttttgtcgccgtgaaccaatggattttggtcaaaggcgttatcggcggcattgaaaaagcggcaaaatagctgatgccgctgctgtttttgttcctaatcgcgatggtcgtccgcaacgttacccttccgggcgcaatggaaggggttgctttctatctgaaacctgatttcagcaagattaccgccgaactgttcgtcttcgttttggggcaggtattttttgccctgagcttgggtttcggcgtgatgattaccttgtccagctatttggataaaaacgaaaatctggttcagacggcagttatcacggcaattaccaataccatcatcgccatacttgcgggctttatgattttcccgtcgctcttcagcttcggcgttgcccccgattccggcccgactttggtgttccaaagcttgccgattgtgttctcacatatgtgggcgggatctgtgttcgccgtgattttcttctcgctgctcctgattgccgcgttgacaacttcgctgaccatttatgaagtgttgattacgaccattcaggaaaaaaccaaaatccgccgtaccgccgcgattacgattgtattggctgccatcttcattttcggcaacatcccgtccattctgagctatggtccgtggaaagacgttccgtgttcggcaaaaatattttcgatgccttcgactacatcagcggcaacatcttgtttatgctgaccgcgctcggttccgcgctgtttgccggttttgtgatgaaggacgaagcgaaggacgaattgctttataaaggcaaccatacgacggtcaatatttggtttgcttatgtgaaatatcttgtgccgctggtgattctgctgattttcgtcagcaacctgttctaatccgcagcaatcgatgccgtctgaaggtcatacctctttcagacagcattgccttgatgcccgccacaatacccgcaacgccgaaatccgaaccggcttgccggcttctgtcggatgtttccgggcaggcggcgttccgtctgcttagacaatcgtcctttaaaacaggtagaatccgccccaacgggaaacacatccttcagacggcaaaacccataccccaaaccatcaggaatcccccttatgaacagacaaaaagtcatcgccatcgacggcccgggcgcatcgggcaaaggcacggttgccgcccgcgttgccgccgcattgggatacgattatctcgataccggcgcactctaccgcctgactgccctatatgcacaaaaacaaggcgtgggatggcacgatgaagaaaacgtttccgaactggcaaaaaaactgcccgccgtattttcaggcagccgcatcctgctcggcggcgaagacgtttcagacggcatccggacagaagccatcggcatgggcgcatccgcagtcgcacagttgcctaaagtccgcgccgccctgctgcaacgccaacgcgattttctgaccgaaaaaggactggttgccgacggacgggacaccggatcggtcgtcttcccccaagccgaacttaaaatcttcctgacggcagaatccaaaatccgtgccgaacgccgcgccaaacaaatcggcatcccctgcgaaggtttggcattcgagcgcatcctgtccgacatcgaagccagagacgaggcagaccgaaaccgcaaagttgcccccctgaaacaacagcccgatgccctgcttttggacacaagccgcctgactatagaagaaactgtaaaaaaagtgcttgattggtatcgtgaagtttaaattttcaggtataatcgcacaaattacgtttcagacggcataaaaatcccccatatgccgtctgaaaccttatgtacccgtctgccctgccaaggacggcagatatccaccaacccaccccgcaccccttggcggtgtaccgaaaagagttatatatgtctatggaaaattttgctcagctgttggaagaaagctttaccctgcaagaaatgaacccgggtgaggtgattaccgctgaagtagtggcaatcgaccaaaacttcgttaccgtaaacgcaggtctgaaatcagaatccctgattgatgtagctgaattcaaaaacgctcaaggcgaaattgaagttaaagtcggcgacttcgttaccgttaccatcgaatccgtcgaaaacggcttcggcgaaaccaaactgtcccgcgaaaaagccaaacgtgcagccgattggattgccctggaagaagccatggaaaacggcgacatcctgtccggcatcatcaacggaaaagtcaaaggcggcctgaccgttatgattagcagcatccgcgcattcctgccgggttctttggtcgacgtacgtcctgtaaaagacacttctcacttcgaaggcaaagagatcgaattcaaagtgatcaaactggacaaaaaacgcaacaacgtcgttgtttcccgccgcgccgttctggaagccactttgggtgaagaacgcaaagccctgctggaaaacctgcaagaaggctccgtcatcaaaggcatcgttaaaaacattaccgattacggtgcattcgttgacttgggcggcatcgacggtctgttgcacatcaccgatttggcatggcggcgcgtgaaacacccgagtgaagtcttggaagtcggtcaggaagttgaagccaaagtattgaaattcgaccaagaaaaacaacgcgtttccttgggtatgaaacaactgggcgaagatccttggagcggtctgacccgccgttatcctcaaggcacccgcctgttcggcaaagtatccaacctgaccgactacggcgcattcgtcgaaatcgaacaaggcatcgaaggtttggtacacgtctccgaaatggactggaccaacaaaaacgtacacccgagcaaagtcgtacaactgggcgacgaagtcgaagtcatgattttggaaatcgacgaaggccgccgccgtatctctttgggtatgaaacaatgccaagccaatccttgggaagaatttgccgccaaccacaacaaaggcgacaaaatctccggcgcggttaaatccattaccgatttcggcgtattcgtcggcctgcccggcggcatcgacggtttggttcacctgtccgacctgtcctggaccgaatccggcgaagaagccgtacgcaaatacaaaaaaggcgaagaagtcgaagccgtcgtattggcaatcgacgtggaaaaagaacgcatctccttgggtatcaaacaactggaaggcgatccgttcggcaacttcatcagcgtgaacgacaaaggttctttggttaaaggttccgtgaaatctgttgacgccaaaggtgctgttatcgccctgtctgacgaagtagaaggctacctgcctgcttccgaatttgcagccgaccgcgttgaagatttgaccaccaaactgaaagaaggcgacgaagttgaagccgtcatcgttaccgttgaccgcaaaaaccgcagcatcaaactttccgttaaagccaaagatgccaaagaaagccgcgaagcactgaactccgtcaatgccgccgccaatgcgaatgccggcaccaccagcttgggcgacctgctgaaagccaaactctccggcgaacaagaataaggttgcagacatgacaaagtctgagttaatggttcgtttggcagaagtgtttgccgccaaaaacggcacgcatcttctggcaaaagacgtagagtacagcgtaaaagtcttggttgacaccatgactagatcgcttgcccgaggtcaacgcatcgaaatccgcggtttcggcagcttcgatttgaaccatcgtcctgcccgcatcggtcgcaatcccaaaaccggcgagcgtgtggaagtacctgaaaaacatgtaccccacttcaagcccggtaaagaattgcgcgagcgggtcgacttggctttaaaagaaaatgccaattaaaccttagcatcaaaacgccgctgttacgcggcgttttttctgtggtttaacttcatccgttgcttcaataccttgagccaagcaagcaacggattagagcgtggatttttttatagtggattaacaaaaaccagtacggcgttgcctcgccttagctcaaagagaacaattctctaaggtgctgaagcaccaagtgaatcggttccgtactatttacactgtctgcggcttcgtcgccttgtcctgatttttgttaatccactatatcattgcttacaatccgctttttaaacaacaaatttttgatttctattacgaacaggacaaaaatcctgcttattgcactaaaactaagccgtttcaggaatttgcggcaaatttacagcttttaccgagcctaatgctttcgctttttggtaaaacgccaatttgtattcaagcaaatctaaatagcgttttaattcggcaatttgacacttcacattttctatttgattttcaaacaaggaaaggcgttcttcaatggtatcgtcgccaatgacggtacattccgcaaagcgtttgatgtcttttaagctcattcccgtatttttcaagcattgcaataagcccaaccattgcaaatcgttatcggtaaaacagcggttaccgtattcatcacgtccgatattgggcaacaaaccttctttgtcgtaaaaacgtagggtgtgggcggagatgcctattttttcggcggctttggcagtagtataagtcattttccctccttctaaacaaaaacagtaaaaaacacttgctttagagttaactctaaagtgtaaactgttgctatgttgctcaggcaaggcaactttgtcaatgaattaagaggaaagacaatggaaatgaaacaagccgattcaaccatcaaatctcgtgcggcggtggcattcgcccctaaccaacccttacaaattgtggaaatcgacgtagaaatgccgcgtaaaggcgaggtgttaatccgcaatacccacactggcgtgtgccatactgatgcgtttacgttatcaggaagcgatcctgaaggcgtattccctgtggtgcttggacacgaaggtgcgggtgtggtcgttgctgtgggcgaaggtgtgtcaagcgtaaaaccgggtgatcacgtgattccgctttacaccgccgaatgtggcgaatgtgagttttgttgttcaggtaaaaccaacttgtgcgtctcagtgcgtgatacacaaggtaaaggcttaatgccggacggcacgacgcgtttttcttatcaaggtcagccaatctatcactatatgggctgttcgactttcagtgaatactccgttgttgccgaagtttcactggcgaaaatcaaccctgaagccaaccatgaacaagtatgtttgctcggctgcggcgttaccacaggtattggtgcggtacataatacggcaaaagtgcaagaaggcgactctgttgccgtgtttggtttgggggcgattggtttggcggtggtgcaaggtgcgcgtcaagccaaagccggccgcattatcgccattgataccaatccatcaaaatttgagttggcaaaacagttcggtgcaacggattgtttgaacccgaacgattacgataaaccgatcaaagatgtgttgttagacattaataaatggggcattgaccatacctttgaatgtatcggcaatgtaaacgtaatgcgtcaggcattagaaagtgcacatcgtggttggggtcaatccattatcatcggcgtagcaggtgcaggacaagaaatttcaacgcgtccgttccagttggtaacaggtcgtgtttggaaaggttcagcatttggcggtgtgaaaggtcgctctgaactgccgaaaatggtggaagattcaatgaaaggcgacattgagttagaaccgtttgtaacccacacaatgacactcgatcaaatcaataaagcctttgacttaatgcacgaaggtaaatcgatccgcgccgttattcactactaaggtatgcgatgaaactgattgaacaacatcaaatttttggtggttcgcaacaagtttgggcgcatcatgcccaaacgctgcaatgcgaaatgaaatttgccgtctatttgccaaataatccagaaaatcgaccgcttggtgtgatttattggctttccggcttgacgtgtacggaacaaaatttcattaccaagtcaggctttcagcgttatgcggcagaacatcaagtaattgtggtggcccccgataccagccctcgcggagagcaagtgccgaacgatgatgcttacgatttaggacagagtgcaggcttttatttgaatgcgaccgaacagccttgggcggcgaattatcaaatgtatgattacattttgaacgagctgccccgtctgattgagaaacactttcctaccaacggcaaacgttccattatgggacattcaatgggcggacacggcgcattggtattggcgctgcggaatcaggaacgttatcaaagtgtttctgccttttcgcctattttatcgccaagcctcgtgccgtggggagaaaaagcctttactgcttatttagggaaagaccgtgaaaaatggcagcaatatgatgctaactcactcattcaacaaggctataaagtgcaaggtatgcgcatcgatcaaggcttggaagatgagtttttgccgacacaattgcgtaccgaagattttatcgaaacctgccgtgcggcaaaccagccggtcgatgtgcgtttccataaaggctacgatcacagctattacttcatcgccagttttattggcgagcatattgcttatcacgccgcgtttttgaagtaaaccaaagagcgttcagtgttcaaagcagttttgggatagccggcacgagggcggtaagaagtgccggcataaacgtatgccgtctgagccgaaaggagccgactctacggattatagtggattaacaaaaatcaggacaaggcgacgaagccgcagacagtacagatagtacggcaaggcgaggcaacgctgtactggtttaaatttaatctactataaaaggcatttgagctcatatctgcaccatattgaaacgccgcctttgcttatacccccttgtgcgcgtcattattcttttccacggaaaatgccaagtttgaaggaaatcatttataataccgacggtaagcattttctttcttagccgcaagaagtataacaaggttaaatatgagtaatagagaccaactttttaaagccccgccgtttgaaaaccacagcccgctgacctggtatcaggctgcctcacaactgcccaacttcatccgcgacgacgcgcaggcagccgccatcgaacacctcgatcggctttggaccgaattgatgatgttcaaacgcaaaagaaaccgttttttaggcaggagtttgcgttccccgcaagtccccaaagggctttatttctatggcggggtcggacgcggcaaaagctttctgatggacgcttttttcggctgcctcccgtaccgccgcaaacgccgcgtccactttcatgcctttatggcagaaatccaccagcggctgaaaaccctgaaaagcgaaagcaacccgttgaaatccgttgccgccgagattgccaaagaaacccgcgtattgtgttttgacgaatttcatgtcagcgatattgcggatgcaatgattttaggccgtctgctggaaaacctgcttaacgagggcgttgttttggtggcgacttcaaactacgcgccttccgaactctacccgcaaggtcaaaaccggagcagttttcttcccacaatcgcgctcatcgagtccagcctgaccgtcttaaacgttgacggcggtgaagactaccgactgcgtaccctccgccccgccgagattttctttacgcctgccaatgaagaaaatgaggcaaaactggcaaaactgttcaaagaaatgacaggcattaccgatttgaaccccggcatcagcaccatccacggtcgggagattccccacaaagccgagtccggccgtgccatatggtttgatttccgcgcactgtgcttcggcccccgctcacagtccgactatctgtatttggccgaacattatgaaatggtttttatttcaggtttggaacaactctcaccgcaagaaaaggcggaggcgcggcggctgacttggctgattgacgtactctacgatttccgggtcaaactgtgtgccaccggcgcggtagatgtcaaccatatctatacggaaggcgattttgccgaagaatttacccgcaccgccagccggatggtcgaaatgcagtccgaagtttatttggaacagccgcacctgaccctatctcccaaggcttcaggcggataagttatttttttgatagaataccgatttgattcttcttaagtaaaaataaggatatagcatggcgattgaacgtaccatctccatcatcaaacccgatgccgtcggcaaaaatgttatcggcaaaatatacagccgctttgaggagaacggtctgaaaatcgttgccgccaaaatgaagcagcttactctcaaagaggcgcaagaattttatgcggttcataaagaccgccccttctacgccggattggttgaatttatgaccggcggtccggttatgattcaggtattagagggtgaaaacgccgtcctgaaaaaccgcgaactgatgggtgcaactaatccttccgaagccgccgaaggcacgatacgcgcggactttgccacttcggtcagcattaatgccgtacacggttccgacagcgtggaaaatgccgctttggaaattgcctactttttcagccaaaccgaaatctgcccccgttgatacaatacaccgcccaactcctcttcagacggcataaatatatccatgccgtctgaaaactctgttgcaaaaggcttcaaatcaaacttgcctgccctgcaattttttatttgaagccttgatttaagaaaaacacaaacacatgaaaaccaatctgctcaactacgaccttcaagggctgacccgacattttgccgatatgggcgaaaaacctttccgtgccaaacaggttatgcgttggatgcaccaatccggcgcgcaaaattttgacgaaatgaccgatttggcaaaatcgttgcgccataaactgaacgaacaggcaggcatcgaaattcccaagctgatgatgtctcaaaaatcttcagacggcactcgaaaatggcttttggatgtcggtacgggcaacggcgtggaaaccgtcttcatccccgaatcggatcgcggcacgctctgcatttcctcacaagtcggctgcgctttggaatgtacattttgttcgaccggccggcagggcttcaaccgcaatttgactgctgccgaaatcatcgggcaattgtggtgggcaaacaaagcgatgggcgttacaccgaaaaacgagcgcgtgatttccaacgtcgtcatgatgggcatgggcgagccgatggcgaacttcgacaatgtcgttaccgccttaagcatcatgctggacgaccacggctacggtttgagccgccgccgcgtaaccgtttccacttcgggtatggttccccaaatggacaggttgcgcgatgtcatgccggtggctttggcggtttccctccacgcttccaatgacgaagtccgcaaccaaatcgtaccgttgaacaaaaaatatcccttgaaagaattgatggccgcatgccaacgctatctggtcaaagcacccagggatttcatcactttcgaatacgtcatgttggacggaataaacgataaggcgcaacatgcgcgcgaactgatcgaactggtcacagatgttccctgcaagttcaatctgattccgttcaatcccttcccaaactccggatacgaacgctccagcaatgagaacatccgtgtgttccgcgatattttgcagcaggcaggatttgtcgttaccgtacgaaaaacgcgcggcgacgacatcgatgccgcctgcggacagttggcggggcaggttcaggataaaacgcgccgccaacaaaaatggcagcagattttaatcggacaacaggggtaattatgccttttaagccatccaaacgaatctctttattactcgttcttgccttgggcgcgtgcagcacttcctaccgcccctcgcgggcagaaaaagccaatcaggtttccaatatcaaaacccagttggcaatggaatatatgcgcggtcaggactaccgtcaggcgacggcaagtattgaagacgccctgaaatcggaccctaaaaacgagcttgcctggctggtccgtgccgaaatctatcaatacctgaaagttaacgacaaggcgcaggaaagtttccggcaagccctctccatcaaacccgacagtgccgaaatcaacaacaactacggttggttcctatgcggcaggctcaaccgccctgccgaatctatggcatatttcgacaaagctctggccgaccccacctacccgaccccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcaccggtcaataaacagattcaaaccatatgaacacactccaacgccgcaagacgcatcaagtccgcatcgatcatattaccgtcggttcagaagcacccgtcgttatccaatctatgaccaacaccgacactgccgatgcaaaagccaccgcattgcagattaaggaattgagcgatgccggatccgaaatggtgcgtattaccgtcaacagccccgaagccgcgtccaaagttgccgaaatccgccgccgcttggacgatatgggctatgccacaccgcttatcggcgatttccacttcaacggcgaacgcctgttggcggaatttccagaatgcggcaaagcattgtccaaataccgcatcaatcccggcaatgtcggcaaaggcgtaaaaggcgatgaaaaatttgcctttatgattcggactgctgctgaaaacgataaagccgtccgcatcggcgtaaactggggttctttggatcaaagcctcgccaaacgtatgatggatgccaacctcgcttcttccgcgccgaaaccgcccgaagaagtgacgaaggaagcactgattgtctccgctttggaatctgccgaaaaagccgttctattgggactgcccgaagacaaaatcatcctgtcgtgcaaagtcagcgcggttcaggatttgattcaggtttaccgcgaactgggcagccgttgcgcctatccgctgcatttgggtttgaccgaagccggtatgggcagcaaaggcattgtcgcatcaacggcggcattatccgtcttgcttcaagaaggaatcggcgacaccatccgcatttcactgactccggaacctggcagcccgcgtactcaggaggtcgtcgtcgggcaagagattttacagactatgggattgcgttcgtttacgccgatggttaccgcctgccccggctgcgggcgtaccaccagtaccgtatttcaagagctggcacaagatgttcaaaattacctgcgccaaaaaatgtctatatggcgtaccctttatcctggggttgaatccctgaacgttgccgtaatgggctgcgttgtcaatgggcccggagaaagcaaattggccgacatcggcatcagcctgcccggtacgggagaaacacccgttgcccctgtttatgtagatggtgaacgtaaagtaacgctgaaaggcgacaacattgcaacggaatttctggctattgttgaagagtatgtcaaaaccaattatggggagaacggactcaaacgccatcaagggaaggttatcccgatacactccctataaaatccaaccgccagcctaccttggctatttttaaataaaaaccgtttattttcattgatataaaacccatcccattggaaaaggcatttttttaaaccgataaggaatggaggcgcaatatgaaaatacaatcggcaaatacggagatgaattgcaggtataaataaggaaggcgggataccgcttcctgcccttgtcttttctcaataaccgtaccggcagattcaggaggatgcgagtgtcgcgcccttgcaaaaactgctgccccatttggctttcagacggcatccgtccatcacaggcgggaacggggatcctttaaaaaactccaaatccttcttccgtcccgtggatgacggtatcgataccatatcaaacgcagcttgaaacaaatgccgtctgaacgtttcagacggcatcggtttctctcaggtttcttttattaaagccgcaaagaagcgcggttttccaaaatctggtcaatcaaaccatattctttggcttcttcggcagacatgaaattatcacggtcggtgtcgcgttccaaatctgccaaatcgcggtcgcaatgtttcgccatcaggcggttgagtttttctttgatttttaaaagttcgcgtgcgtgaatttcaatgtcggatgcctgaccgcccagaccgccgctgattaaaggctggtgaatcataatccggctgttgggtagggcaaaacgtttgcctttctcgcctgccgacaataagaacgcgcccatacttgccgcctgccccaagcacaaagtcgatacatcgggcttgatgaaattcatggtgtcgtaaatcgacataccggccgttaccgaaccgcccggcgagttaatatagaagaaaatatccttatccggattctcactttccaaaaacaacagttgggcaaccaccagattggcggactcgtcggttaccggtccgaccaagaatacgatgcgctctttcaaaagccgggaatagatatcgaatgcacgctcaccgcgaccgctctgctcgataacggtagggacaagatagttatcaaaagacatttcgtctcctttcatgatggaaaagcaccaaagcgagctttaaaagcggcttcggtgctttcaaaaactgccttcagacggcattttcaggataatcaggcttgcgcgcccatcacttcgtcaaaagacaaagctttttcatttactttggctttgcccaaaacgaaatcaacgacgttgctttctaccgccaaagaagtcggggcttgcaggcgggaaggatctgcgtagtaccagtcaatcacttcttgaggatcttcgtagctttctgcaaagttggcaacaacggctttgatttgctcttcagtcggttccagtttgttttcgtcaaccagtttggctaaaatcagacctaaagatacgcggcgttcggcttgttctttgaacatatccaaaggcagatccaagttggcagcatcagccataccttggttaacaaaattttgtttcatttcgtttgccaagcgtgcggcttcttcattgaccaaagcaacaggtgctttcagctctacggctttgagcagcgcgttcattacggattctttggtttgttcgtttacgcggcgttccacttcgcggcttacgtttttctgcacttcttcgcgcattttggcaacgtcgccatccgcaatacccaaggcttttgcaaaatctgcatcgacttcaggcagagtcgcttcggaaacgttgttcagcgtaatggtaaacacggcagttttaccggcaacgtctttaccgtggtagtcttcagggaaattgacggtaacgtctttactttcgccagccttcatgccgactacgccggcttcaaattcaggcagcatttgacttgcgcccaatacgaaggcgtagtttttggatgcgccgccggcaaaaggttcgccgtcgattttgccttcaaagtcaatgatgacgcggtcgccgtttcgggcttcgcgttcgacatggttgaagcgggtgcgttgtttgcgcaggatttctacggtttggtccacttcggcatcaccgacggaagcggttactttttcaacttcttgtgcagacaaatcgccgataacgacttcggggaacacttcaaaaatggcggcaactttgaaagactctttatcgtcttgttcttcaacgccttcaaaacgggggaagcctgccactttcaactcttgggcaacggcaacatcgtagaagcggcgttgcaccagctcgttgatcacgtcgttttgtgcgctcgcaccgtacatttgggcaatcatttttaaaggtgctttacccggacggaaaccgtcgatttttgcacggcgttgggtttgtttcagttttttatcggtttctgcgttgatttcggaccaaggcagggacaacactactttgcgttccagattttctaaagtttcaacagttacgctcatcataagcccttaaatttgttgtgttgataaaatgataaactttcttccctacatggggaagcaaacagcgcaacggtacgatatttgaaccgcattgccgcaaaggggaaattttagctggcaagtatatcacaatgtttcgcctgaaacataatatgccgtctgaaacgccaattccgccgttcagacggcattttgcaatacgggctacaaatggtccttgtgcgccaaaattttacggctgccgttgaggtcggtggaagaaacgacacccgcattttccagtgcctccatcaggtttgccgcgcggttatagccgatgcgcagctgccgctgcaaagacgaaatggaggtttttttgctttccaaaacataggcgactgcctgatcgaacaattcgtcgctgtctgcattcggattaacgatattggcagtttccagcgcggcctcgccgctgagcagaccttcaatatagtcggctggggcttgcgatttgacatagttgacgacttgatgtacttcgtcgtctgaaacaaacgcgccttgcaggcgagtcggttcggcactgccgggctggaggaacagcgaatcgccatatttgagcagttcgtccgcgcccatttggtcgaggatggtacggctgtcgattttgctttgcacggtaaacgccatacgcgtcgggatgttggctttaatcaggccggtaacgacatcgacactgggacgttgggtggcgacaatcatatggataccggcggcgcgcgctttttgggcgagacgggcgatttgctgctcgacggctttgcgttcggtcatcatcaggtcggcaagttcgtcgataacgaccacaatcaacggcagtttttccagcggctcgggctcgtcggggttcaggctgaacggattgagcagcggcttgcctgccgcttttgcggcttcgactttttggttgaagccctccaaattacgcacaccggcatgggaaagcaggcggtagcgtttttccatttcggcgacgcaccagttcaacgcctgccctgcttcgcgcatatcggtcacgacgggacagagcaggtgcggaataccgtcgtaaatgctcaactcgagcattttcgggtctatcataatgaagcggacttcgtcgggcgtagctttgaaaagcatagacataatcatgccgttcacgccgacggacttgcccgaaccagtcataccggcgaccaaaaggtgcggcattttcgccaagtcgccgacaacgggggtaccggcaatgtctttgcccagcgcgacggtcagcttggatttggcttcggcaaacacgggcgaggacaagatttcactcaacatcacgtcttggcgtttgtcgttgggcaactcgatgcccatcgtgtttttacctgcgatggtttcgacgatacgcacggactgcagcgacatagagcgtgccaaatctttcgacaaggcaacaatttggctgcctttaacaccttgcgcgggttcgatttcgtagcgcgtgatgacggggccggatgtggcggatacgacttgtacgccgatgccgaattctgccagtttggattcgatcagttcggcagtgcgctccaattcggcgggattgatgctgacgggttcgctgtcaggaatccgcaataggttcaatgtaggcttgtggtattcgcccgcctgccgaggttcgtcatcttcaaacagagaaacctgaattttgggcggcggcgcgacggaaaccgcgacggatttgcggttgctgctgctgccttcgggcaaggcaacgggtttggccgtaatattcttggcttcttttaccatgcgccgtgtattttgggtatcgacaccgtctgttttggtattcggccggcgttttcctaaagccatgaccttgccggataaggcactcaggcggttttgaaccgccctgcccgcaccgttcaaaaattccagccatgaaatctgcaccagcagggacaacgacaacagcagaacaaccaagataatcagcaggctgcccgatttccccagcagccacgcaaacactgcgccgacgcgtatgccgaccataccgcctgctccgacaggcagggagtcggcatattttccgcccagcacaaaatactccaagacggggctgaagaccgtcaggacaaacagcgcggcggcagcgattttgtggttgtatgcctcgttttccgtctgttttgcgtgcaggcggaaatttttatacagcacgacgcaggcagccgctatccaccaccagaacgaccagccgaaaagataatagccgacatcggcaacatacgcgccgaacagtccgccccaattggcgacatcttccacaaccggcgaactgtgcgaccaagacggatcgcccatatcgaaactgatcagggaaatcgccaaatacagggttgccgccaaacccatcagccacagtgcgtcgccgataaggttgacgacatgttcgggacgcgcctttttggtttcggttttctgcaactctttgaccgccttgagccgctcggaaactttattgccccgtgcgccgttgtcggctttcttgttgcgtgcggacgttggggacgggcttcccgccctgccttttgctgtttttttatgggatttttctgtcatgccgtattaccggaaaatgccgtctgaaataaggaagccggacggcttgcggattgaatatggaaagtgtcggattatactccatttctcctgctttcatcctgcaacagacagacattgcctttcagacggcatatctgttgcccgacgtatgtatttttacgcagaccctcggcaaaccagtataatccgtgccgtttgaaccgattgaaagaagatggtatgaaccaactgaaacttgccgtttccggtgcacagattttatttgtggcattcggcgcaatggtgctggttcccctgctgaccggtctgaatccggctcttgcgcttttgggcgcaggcttgggaacgctgctgttccaaatcacaaccaaacgcaaagtgccgatttttcttggttcttcgtttgcctttatcgcaccgattatctactccgtcggcgaatgggggctgccttccaccatgttcggactgtttgccgccggctttatgtattttgtgtttgccgcgctgatccgttggcgcggactggcagcggtacacaaactgctgcctccggtcgtcatcggccccgtcatcatggtcatcggtctgtctgttgccgtggcggcaagcagcatggcaatgggtcaggcggacggcaaacaggtcatcgactataccgattcgctgattctttccggctttacctttgccgttaccgccatcgtatcggttttcggcagcaggatgatgaagctgattcccatcttgatcggtgtcgcttcgggttatgttttggcactgctgatgggactggtggacacggcaagcattgcacacgcgccctggttcgccgttccccattttgaaacgcctcagatcaactggcaggctgcactgtttatgctgcccgttgccgtcgcccccgccatcgaacacatcggcggcatcatggcaatcggcaatgtgacggggaaagactatacgaaagacccgggcttggacaaaacccttgcaggcgacggtttgggcgtatgcgttgcgggtctgatcggcggcccgccggttacgacctacggcgaagtaacgggtgcggtgatgattaccaaaaacagcaaccccgtcatcatgacttgggcggcggtttttgccgtctgcatggcgtttttcggcaaattcaatgcgtttttggcttccattccgatgccagtaatgggcggcattatgctgctgctgttcggcacgattgcttctttgggcgtgaaaacgctgattgatgccaaagtcgatttgatgctgccgaaaaacctggtcatcgtcagctcggtactgaccacgggcatcggcggcatgacgctcaaattgggcagcttcagctttgccggcgtgggcttgtgcgccgtacttgccattatgttgaacagcctgctgcccgatccgaaagaatcctgaccgtcgatatagaaatgccgtctgaacatctttcagacggcattttccgttttatttgagattttgaatcaaagagcgcacagttccgccgtaataagaagaagatgtgcaatacactgtttccaagccgcattgtccctgtacgccgtattttttgatgcactggttgagtgcgacctgatgaacgctcgtaaaacgcggagaagtaatcacgacggcgttgtcgacacgcagcgcgcccaaggctttcgggtatgccagcgcgacacaggtattgttcagcgacacgaccgaccggcatccggtcggctcgtcttcagcaatgcccgcaagcgtgtcctgacctttgcagaaggcttccaactcggaaaacgcttcgcttttcgtcgaatcttcttttgtggttttaacctgcaaaacatcgtccgcattctgcggattctgccaaacggcgagatagccgtaagtatcggcagcccgtgccgccgcagtcatcaggcatagtgccgatacggccagtatctttttcatcatgataaattcccgacggttcgtccaaattctgttgcattataaacaaaaaacaggataagtcccgccttatcggcttatccctccccgcagattgcaccgccgggtatggcaaaccgatttcagcagcgcaaatccgcataccgccgccttagcggcaagccgttgttttcagacggcattgcggccaacctttgcggcgggcgaaaaaccttgtcctataatttatcccgtttcaaaatcagcatacggtcggaaatgcaaaaaatatctttcaatttgttgaagcctgcaaactccccgaaaatagggaaacgccgccccggtttgaacggcgcgccgcatattccgatgccctccccccgataccttccggcaagcccagaaatgcccggcaacaacatccatccggcaaaaatccgaaacaacacacccggcggcaggcagagtcaaaccgccccgcaaagcatccgccatcagaaaaacaaaccgcctccgagggcttcatcctaaagggcgtattgttcgataatggtttgggttataatcccctatcgattctccacgtccgtgagacacttcagctatggaaaccccgaccaacaccccgcaacgctccctgcgtcaaaacagtatctacctgctgcccaattcctttactatcgccgcgctgttttccgcgttttacgcaatcacccaatccatgcacggacgttatgaaaccgccgccatcgcggtattcatctctatgttgctggacggtatggacgggcgcgtggcgcggctgaccaacagccaaagcgcgttcggggagcagctcgacagccttgccgatatggtcagcttcggcgttgctcccgctctgattgcctacaaatggcagctttggcagttcggcaaaatcggttattccgtcgccttcatctactgcgcctgcgccgccctgcgcctcgccctgttcaacacactcatcggcaaggtggacaaacgctggtttatcggcgtgcccagtccgactgccgccgcgctgattgtcgggctgatttgggtcaaccacagcgtcgaaaaattccccgccgtccactggtgggcattgggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtcctcttcctgttctttctcggatacagcctgtccggctacattatggcggcacgccgattttggaaaaagtacagaaaggcggattaaatgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaaaacacacgaaaaaacctttttaccgtttgcacaagcaattaatcaggacaaagctgcccagtctcctgttccgacaaaaggacagacaacctgaccgagacctttgcagaatatacgaaaaacaaaacaaataccgtctgaaaccacattccgacaatcggcagggtttcagacggcatctgataatttcaattactcggttgcggcaacgacggcaacggtaattttagcaacggcatcagtgtgcaaagccacttccacttcgtactcgccaacggctttcagaggaccgttcggcagacgtacatttgctttcacggcttcgatgccggcagcaacgattgcagcagcaatgtcggcattggtaacggaaccgaacaggcgaccgtccacaccagctttttgagcaacggtaacggtttgaccgtccaatttttcctgacggactcgggcatctgccaaaatttcagcctgtttggcttccagttctgcgcggcgtgcttcaaactctttcatattcgcttcggtcgcacgttttgccttacctgcgggaattagaaagttgcgggcgtagccgtttttaacggttacgatgtcgcccaagttgcccagaccgccgattttttctaacagaataatttgcatgattcaatctccaaaattatttgtgttggtcggtgtaaggcagcagagccaggaagcgtgcgcgttttacggcaacagccaattggcgttggtagaatgccttcgttcctgtgatgcgtgcaggaatgattttaccgttttcggagatgaagtctttcagcaaatcaacttgtttgtaatcgacttcttggattttttcagccgtgaaacggcagaattttctacgtttgaatgattgacgagccattgtcgtttaacctttatattcttgaatattttgtatcctgagcatcggcataagggaacgtctgcttttttgagctaaaaaaccttcgacgtgaacatatacaccttgccgatactgccactcttccgcctgcctgcctaaaatccgtgccggaatttccaattggacaaggcattgctgcccgttttcctcctgccacgattcgtgctttaaaataatatctaaaacagggattccggcaggcgtatatcgaatagggaaaaccttttcaattaacgcggcaagcgaaacaagattattgaatcccaattattgggcgaccgcttcttcagacgcaccgctcaacaggttcttagccttttcaccacccaacataggggatgcttcggtaacggcgtgtttggttttgatggtcagatgacgcaatattgcatcattgaagcggaatgcggtttccagctcttcaaccacttcgggagtggtttcgatgttcatcaaaacgtaatgggctttatggattttgttaatcgggtaagccagctggcggcgaccccagtcttccagacggtgaatcttaccgtttgcttcggcaatcatggttttgtaacgttcaaccatagcgggtacttgctcgctttgatcgggatgaacgataaacacgatctcgtaatgacgcatgttatctccttatggatggtaaaaacagccttctgccatgcgaaagcagaaggcaaggtttaaagaagcggcattatattggggtttgccgacggaatcaaggatttggtgcgaaaaatttgcattccgccgaaaatttcggtttcagacggcattcaaatgttttggctgcccagccagcgttccgcgtccaaagccgcctgacagccggaagccgcgctggtaatcgcctgacggtaggtatggtcttttacgtcgcccgccgcccatacgccttcgatattggttgcgccgacattgtccgccgtgccgcctttggttttcaggtaaccggcttcgtccatttccaactgacctttgaaaatatcggtattcggcttgtgcccgatggcgataaaaatgccgctgacggcaatttgttgctcagaaccgtcgttgttttttaataatgcgccgtttacgccccgatcgtcgcccagtacttcttgcaggttgctttccagcttgaggatgattttgccctcttccacgcgtttcatcagtttgtcgatcatgattttttcggcacggaactcgctgcggcggtggatcagggtaacggttttggcgatattggcaaggtagagtgcctcttcaactgccgtattgccgccgccaactacggcaacatcttggtttttatagaagaaaccgtcgcaggtggcacaagcggaaacgccttttcctgcaaacgcttcctcactcggcaaaccgaggtatttggcggacgcgcctgttgcgacaatcagggcatcgcaagtgtactcgcccatatcgcctttgagtgtaaacgggcgtttttgcagatcgacggcgttgatttggtcaaaaatgatttccgttccgaaacgttcggcgtgggcgagaaaccgcgccatcaattccggcccttgcacgccgtcggcatcggcaggccagttgtccacttcggtggtggtcatcagttgcccgccttgcgcgatacctgtaataatgacggggtttaaattggcgcgcgcggcatagacggcggcggtgtatccggcggggccggaacccaaaataatcagtttgcggtgttgggacattgtttttcctttgctgtgtcaagttttcggattctactcgaattatcggcgcgtttgagaaatttcgaccataccggcgctcagacggcatcccgcagccttaactgccgtctgaatatcaaagcaggaatcacgcttatgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattagcagcatgtaaccgccctgcagccttgtccgaacggataaggctgtctccagcgatatggtaatatgccgtctgaaaccgtttttcaagtaattgatatgaataaagaaacccgttttccggaacacttcgacatcccacttttcctcaaaaacctgcccaacctgccaggcgtataccgttttttcaacgaaagcggcaacgtcttatacgtcggcaaagccgtcaacctcaagcggcgcgtgtccggctatttccagaaaaacgaccattccccgcgcatcgcattgatggtgaaacaggttcaccacatcgaaaccaccatcacccgctccgaatccgaagccctgattctcgaaaacaacttcatcaaagccctgtcgcccaaatacaatattcttttccgcgatgacaaaagctatccttatttgatgctcagcggccatcaatatccgcaaatggcgtattaccgcggcacgctgaaaaagcctaatcaatatttcggcccatatcccaacagcaacgccgtgcgcgacagcattcaagtgttgcaaaaagtctttatgctgcgtacctgcgaagacagtgtattcgagcatcgcgaccgtccttgtctgctttaccaaatcaaacgctgcaccgcgccttgtgtaggccacatcagtgaagaagattatcgtgacagcgtgcgtgaagccgcgactttccttaatggcaaaactgacgaattgacgcgtaccctgcaacacaaaatgcaaaccgccgccgctaatctacaattcgaagaagccgcacgttaccgcgatcaaatccaagcgctcggcatcatgcaaagtaatcagtttatcgacagtaaaaatccgaacaatcccaacgatatcgatttgcttgcactggcggtttcagacggcctggtttgcgtacactgggtcagcatccgcggcggacggcacgtcggcgacaaaagctttttccccgacaccaaaaacgatcccgagccaaacggacaagattacgccgaagccttcgtcgcccaacactatctgggcaaaagcaaacccgacatcatcatcagcaactttcccgttcccgatgcgctaaaagaggctttggaaggcgaacacggcaagcagatgcaatttgtcaccaagaccataggcgaacgcaaagtccggttgaaaatggcggaacaaaacgcgcaaatggcgattgcacaacgccgcctgcaacaaagcagccagcaacaccgcattgatgaactggcaaaaatcctcggcatggattcagacggcctcaaccgccttgaatgtttcgacatcagccacacacaaggcgaagccactattgcgtcctgcgttgtgtacgatgagcaaaacatccagccttcgcaataccgccgctacaacatcacgaccgccaaacccggcgacgactacgccgccatgcgcgaagtgttgacgcgccgttacggcaaaatgcaggaggccgaagccaacggcgagaccgtcaaatggccggatgccgtgttgattgacggcggcaaagggcaaatcggcgtagccgtatcggtatgggaagaactcgggctgcacatccctttggtcggcattgccaaaggcccggagcgcaaagccggtatggaggagctcatactgccttttaccggcgaagtcttccgcctgccgcccaacagcccggccttgcatctattgcaaaccgtacgcgatgaatcgcaccgtttcgccattaccggtcaccgcaaaaaacgcgacaaagcccgcgttacctcctccttaagcgacatccccggcgtaggcagcaaacgccgccaagccctgctcacccgcttcggcggtctgcgcggcgtgattgccgccagccgcgaggacttggaaaaagtggaaggcatcagcaaggcattggcggaaacgatttacaatcatctgcattagcatgctgtcaaagacaaaatccgtctgtaaaaaatatgatacagcaggtcggtataccgatatatagtggattaaatttaaaccagtacggcgttgcctcgccttgccgtactatttgtactgtctgcggcttcgtcgccttgtcctgatttttgttaatccactataaacctaacttcataacgaataacgatgattcgacaaaacggaaaacgatctgacatgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctgaacagcgttacacctaccctgccgaaacgaaacaggtataatcgcccctttcccttcccgccgtccgaacaggcatttcacattcagacggcatcctgattgcacaagcgtacgaaagcattatgacagacaccgccgagaaccaaacacaaaacaactggcaagccggacacccccgcagcatccgcagcttcgtcctccgccaaagccatatgaccgccgcgcagcaacgcgccatcgataccttatgggacagcttcggcatcgactaccaagcaacaccggccgatcttgatgcccgtttcggaagcagccgacccaaaatcctcgaaataggcttcggtatggggacggcaaccgcagaaatcgcccgccgcctgcccgaaaccgacttcctcgccatcgacgtacacggtcccggcgtaggcaacctgctcaaactcatagacgaaaaccatttagaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagtagcttcgacagcctgcaaaatacggcggcagactacgcccccaccccggactaccgccccgaaaccaaattcgaagcgcgcggcaaacgcctcggacacggcgtttgggacttggtattcaaacggatcggataacaaaccactgtttgaaaatgccgtctgaaacatgtttgcttacagacggcattttttcaagataaagcagcaagtgatgtttcgatataaagtttaaaacaatagtttgaacggcaaaacgcgtgtgtaccgcacgcatccttataggttttatgcacatcggttttaaagtttgtgccgcccgcaggtagtatgtgatagctacgcacgcggttggtgtgatgtaggctacggcttgctggttacaaccgtaaaaaagtaagtgccgccattgcggtaaaaacgaagggatttcatagtgttatgctcgtaatgattttgtagattggattctcgaatccgaccttttgggcattgctgcaatggattgcaacgacgggaatgttgaaggttttgtcggatacaagtatccgacctacgcttgttgctatatatcttttgatttaatgactaaatatgacaaagttaaagtgcagattacagcaagcatgatatgcttctttaggcttttatcattccatgatatagatatttcttccttttcattttctttataaaattttaaacctatatcaccatttttccattcctggtggtttactatgattttatttttaaaagaatctcttaaactttcatgtaaagagttaaattttcttgatttacttcccttagtacatggtgagcaattgtatttctaattttatttaatctctcccctatatcatatacttcgctaaataagccaagattacgcgcaatttttagttttgtgcgaaatccaatttgtgtatcattgaaaaaatcttctttattacattttgcatatatccatgcctctaaaattctttcaaaaaataaatgtgttcgtaagattgaacctatttcatcctgtgtttcaatagcttctttcacgatatcaaaaatcttataatcatcaaaatttgaatttttaataaataattctaaattaaaatctaattgagacataataagtgcccatttcaaaaataaatctatattctagttaatataatagttattctaatatctaaattaaataataaactactatttttatatccacgacaaagtctaagtctcactccgccccaaacaacaaattctctttaatatccctaatcctatcccgcaacacagccgcctcttcaaactgcaaatccctagccgcctgctgcatggctttttcgagtttggcgatttctttaatcgcatcttcttcgttgtgaatctcgcccactttaaccttgtttttacctttcagacggcctttactgccgtcttcttcgtggtacacgccgtcgatgatgtctttgacctgttttttaatctgctgcggcacgatgccctgttcttcgttgaatttaatctgtttttcacggcggcgttcggtttcgtcgatagcggctttcatggagtcggtaattttgtcggcgtacaggatggcgacgccgttcacgttgcgcgcggcgcggcctatggtttgaatcaggctgcggtgggagcgcaggaagccttctttatctgcgtcgaggatggcgacgagagagacttcggggatgtcgaggccttcgcgtaagaggttgatgccgacgagtacgtcaaacaggccgagccgtaaatctctaatgatttcaacgcgctcgacggtgtcgatgtcgctgtgcaggtagcgcactttgataccgagttcgctgtaatagtcggtgagttgctccgccatgcgtttggtgagggtagtaacgagtacgcgttcgcctttttcaatgcggtcgttgatttcgctcattaagtcgtcgacttgggtggcaacggggcggatgatgatttggggatcaaccagccctgtggggcggacgacttgttcgaccacttgtccggcgtgttcttcttcgtatttggcgggggtagcggaaacgaagatggtttgcggcatgactttttcaaattcgtggaatttgagcgggcggttgtcgcgggctgaaggcaggcggaagccgtagtcgacgaggttttgcttgcgcgatgcgtcgcctttgtacatgccgccgatttgggttacggtaacgtggctttcgtcgatgaacatgatggcgttgtcgggcaggtagtccatcagcgtaggcggcggttcgccttcttttttgccggaaaagtggcgggagtagttttcgattcctttgcagaagcccatttcgtagagcatttcgaggtcgaaacgggtgcgctgttcgatgcgttgttgttcgacggggcgttgttcgcgggcgaaaaattcgatgcgttcgcgtaattcttctttgatggactcgcaggcgcgcaagacggtgtcgcgcggggtaacgtagtggctggacgggaagacggtgtagcggccgacgcgctggataaggctgcctgaaagcgggtcgaacatatcgaggcggtcgatttcgtcatcaaacaggctgatgcgtaaggcgttttcggagctttcggcggggtacacgtcaatcacgtcgccgcgcacgcggaagctgccgcgtttgaagtccaaatcgccgcgttcgtattgcatggaaacgagcgtggcgatgatgtcgcgctgctcgatggtatcgccttctttgacggacaacaccatttgttgatactcggtcgggtcgccgataccgtaaatggcggacacggtggcgacgataatcacgtcgttgcgcgtcattaggtttttggtggcggaaaggcgcatctgctcgatgtgttcgttgatcgcgctgtctttttcgatgaacaaatcgcggctgggcacataggcttcgggctggtaatagtcgtagtaggagacgaaatattccactgcgttttcggggaaaaattcgcgcatttcggcgtaaagctgggcggcaagggttttgttgtgcgccatgatgatggcggggcggccgctttgggcgatgacgttcgccatggtgtaggttttgcccgaaccggttacgccgagcagggtttgataggcaaggccgtctgaaagcccttcgagcaggcctgcaatggcggtgggctggtcgcctgcgggcgggaagggttggtggagtttgaagggggaatttgggtattggataacttccataatcttgcctgtgatgcgtttgcggacaaagcgtgcagtagggatgggtcggaaacgtctttcagacggcataaggcggtgaaatcctgaatgtatgccgtctgaaacccaatcgctacccaagtatagtggattaacaaaaaccagtacggcgttgcctcgccttgccgtactatttgtactgtctgcggcttcgtcgccttgtcctgatttttgttaatccactataaatgccgcacggttcaaattccggtaaaaaatcgctcataacctgtcctttcaaacataatatgccgtctgaaatcctttcagacggcatcgtcaaaacctacttcttatcttttttatctttcttatctttatttgaaaccggctttttcgccgccagccccaaagacttctgccactgctcgggcgacttgactaaatccaaagctttccgcaactggtcgtctttggcagggttgggaatccgccttgaagacaaatcctcgtcctttttctttttacctttttcttttacagcgggcttatccgcatctttttcaagcggcacggcaagggtttcaccgttcacatcctcgccgcccaagggattgccgatgtgtccgaccaaatccgcctcgcggctttcaaaaatgcgttccttatcttttacttcgacatcgggaacaatcccctgcgcctgaatagaacggtcgttcggcgtataatacagtgccgttgtcagcttgaccgcgctgccgttggacaaaggaatcaaagtctgaaccgaacctttgccgaagctctgcgtaccgacgatgaccgcgcgtttatgatcctgcaatgcacctgcgacaatctccgacgcggaagccgaaccggaattgaccaataccgtcatcggtatggttttcaactcggcaggaatgcccgccaacgaatcgccgcccatcccgtacacataatcttcaggaatggctttcagtaccatgcggtctttgccgtcgcgtcccttggtgctgacgacgactgcttcagacggcagaaatgccgccgacacgccgaccgcgccagtcaaaagcccgccggggtcgtcgcgcaaatccaacaccagccccttgagcggttttcctttattttcctttaccagctcttttgcggcggtattgacgctttcgaccgtccgctcttggaactgcgacacgcggatatagccgtaatcgggttcgatcaggtgatggcggacgcttttcactttaataatggcacgggtcaggttgacgactatcggcttgtcggcatttttgcgcgacagcgtcaaagtaatcttcgtacccggcttgccccgcattttcttcaccgcttcgctgaccgtcatgccgcgtgtcgaaacattatcgattttcacaatgaaatcgccgcttttcacccccgcccgttccgcaggcgtgtcctcaatcggcgaaaccactttgacaaatccgtcttcctgcccgatttccatccccaagccgccaaattcgccgctggtggactcctttatctcggcataaccttttttatccatatattcggaatgcggatccaaaccggccaccatacccttcatcgcaccttcaaacaaatcggcatcgggtttgtcctgatagtagtttgccttgatttgaccgtaaacctccgccattgtgcggatggattgcaccggcaggacttcgttatcccgcctgtccttctcggcggcaaaaccctgcaccgccagactgacggccacgccgctgattgcacccaaagtataaagtgcgattttcttaaaaacaggtttcgacattcttctttaactttctctcttgatttccaaaaaccggaaaatacaggtacggcaaacggcaaacttcacggaacagcgcaccatatcggcacgatttgcataaagcctaccgtttcggcaatccgatcaacgtatccagctcgaagggttcaatacctgaccttgataacgtatttgcaggtaaagcccctcttccccgtccggcagcgacccgctcgagccgattttgcttcctgccgcgaccatataacccttgccgacggaaatttcgctcaaaccggcatagatgctgatgtagttctcgccgtgatcgaccacgaccactttgccgtagccgtccaactcgtccgcatagcttaccgttcccggcgcaatgctttcaaccgttgccggtgcagtggaatagaacacgcctttccaaatatcgccgccgctccggttctgcccgaaaagtccggtcggcacaccgtcaaccggttttttcaaacgtccttgcatgcggctgaaaccgtcggcactgccgatacccataaccgaaggcgcttggatgttcctgtcttcggcggtcaggttggacatttccgcacgtcgtgcttcagccttctgctgcgccgcttcttttctggctttttcggctgccgccagtctggcttcagccaattttctttttgcttccgcatcctgaatgcggtgttcggcctttttcttctccaaattgctcaagagcttgttcagctgctgctcgttccctttctgttccagcagttttcgggcatctttggcgattttggcattctgtctgcggctttccgtctgttccgccgcatcggttacaccctgttttttcagcagagattgcacgtttgcctgaattttcttcaaacgggcaagctcattgttgattttctgctcttgtaccgccaaagccttctgctgtttttccaaatccttgacaacttcccgattggaggcgtttacataacgcgtataacgcaaaaagcggtttttctgacccggttcggcgtttttcaggaacagggcaaccgcattcggctggctgtttttatagttccccgatacgaaacgggaaatctgcgctttcgtagcggcgacttccgttttcaaacggttcagctcggtattgagtttttggaacttgtcccaagcctcgcgctgtttgcggttgacggaagcaaggttgccgcgcgcctgacggatacgctcttggcggatacgctcttcctgaagctgtttgagggaattgctgacatgaagcagcattccttcgctttgtttgagcagggcttttttgttttcgacatcattggtggcagcggcaacggcggctttcaattcgtcggaatcggttttggcatttttctcttccctgtattttttgtcctgtttcactgctttgccgttcttgtcggaacggacttttttatttgcagaaacagtgtctttttccgccttgccgcccttgcgcggattgccctgtccttttgcctcttttttgccttgtttgttttcaggctgtgtttttgcgtttttttctttggatccggacacgggcttgccatgtgcctttttgtgttccgccttcgatttcttatccccttcgcgtcctttgcgcgcagactgcctggatgtcgcctccttctctgcttctttgcggtttttggcggtttttttggactctttgccctcttttgccgcctctttgccgcctgtttttttatctttcactgcgccatttttgcctttttcttttttgccttccgccgcttcgggctgttcttttttgttcttcgtctgttttttcacttcggcggaacggttgtgtgccgcgtcgtgggcggcaacggcgggcgtggaaaaaacgagcatcagggcaagcagaaggggtttgtagcgcatggttcgaccttcggaaaaagttggataatactgaaggctgcacgaaagcagccggacgtttggattatactgtcagttatgccgtctgaaaatgccgtttgcccaatcttgcgccttctttgcgcggatacttgcaatcggctcaaacagccttatattgtgcgtcatattttcaatgccgcaacggatattgtgttccgacacacagggtagcacattaagccgcataccgtatgttgcccgattttgggaacgtgcgcccctccaaacaaagcaagccctgccgctttcacggaaaacggggattcaaccgataaggaaattttgatgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctgatatgaacctctccaaccactttctcatcgccatgcccgatatggaagacgcgtttttttcacaatcggtcgtctatatctgcaaacacgatgaagacggcgcactcggcatcgccatcaacaaaccctctccgattacgatggacatgattttttccgccaccggcaaaaacatccccatgcggatgcagcacgacagcgtgatgatgggcggtccggtgcaggtcgagcgcggttatgtcgtgcataccccgatcggcaactggcaaagcagtatcggcgtttcagacaatatcgcgctaacttcttcccgagacgtgattgaaaatatttcacgcgaaggtgcggttgacaaagccttgatcagcataggctattcaagctggagcaaagggcagctcgaacgcgaacttgccgacaatgcgtggctgactgttcccgccgacgaacacatcctgttcgacatcccctacgaacaccgttacgccgccgcattcgccaaactcggcatcgacccgctcgccctgttttcaggagccggccatgcataaaattccaaaaggaacggcactggcattcgacttcggcgaagcgcgtatcggcgtggcacaaggagacgcggaattagggctatcccatcctttgagcaccgttaccggcggcagcaacgatgaaaagttcgcggcaatcgccaagctggttcaagaatggcagccgcgttattttgtcgtcggactgcccgtgcataccgacggcacgaaacatgaaatgacgcacctgtcgcgcaagttcggacgcaggctgaacggcaggttcaatctccccgtctattgggttgacgaacggctgtcgtccgtctatgccgaaagcctgctttcggaagcacaggtcttcggcaaaaaacgcaaatcggtgctcgaccaagtggcggcgcaagccatcttgcacggttttttcgagggcggtccggcggaatgtttcaacgggcgtgagggttaagcggcgcggttaacaccctaccgtgaaagaggcgcgcaccaagccgtccagctccaatgccaaattgtcccccgcaccgattgcgcccacgccggagggcgttccggtaaacaccaaatcccctttccccaaaccgtaatctgccgccagtttgtgtaaaatttcccgaatcgggtaaatcatcaaaccggtatccccgcgctgtttcaatacgccgttttgttttaatgaaaacaacaccttctcgggattgccgattctgcctgccgccgcaaaatccgacacgcacgcggaatgcctgaacccttttgccttcagccagggcagccctttttccttcagacggcattggatatcccgtgccgtaaggtccagccctacaccatatcctgcgacacatcccaaaatatctttaccctcgcccgtgccgtctgaatccttaccgaccagcagcacgagttcgcactcaaactgcacatccctactaaactcgggcagcaagattgtaccgccgctgttcaaaatgctgcctgacggcttcataaacaccacaggttcggaaggtatttcgttttttaactcttcgatatgtgcggcatagttcctgccgatacagaaaatattgccgacctcgactgcctctccttctaaaaatactgaagccacttcactttccccctaagtaaaaatgccgtctgaaattattttcagacggcattcgaccaagcttacgcatttaatgaagctgttacacgtgcaacaatttctccgattgcaactgcctgcgcttcgttgtcgcggcgttcggcgtattcgacattgccttctttcaaggcgcggtcgccgatgacgatgcggtgcggaatacccaacagctcggaatcgttcagcaacacgcctgcgcgttcgtcgcggtcgtcgaggaggacgtctgcgcctgccgccagcaattcggcatagattttgtcggcggcttcgcgtacggtgtctgattttttgtagttcatcggcacgataacgacttcaaacggcgccattgctttggtccagatgatgcctttttcgtcgttattctgctcgatggcggcggcaacgacgcgggtgatgccgatgccgtagcagcccatttccataatttgcgatttgccgttgttgtcaaggaagcttacgttcatggcttgggtgtatttgtcgcgcaattggaaaacgtgtccgacttcaatgccgcgcgccagtttcagacggccttgcccgtcggggctttcgtcgccctcgacgacgttgcgcaaatcgacaaactcaggttcggcagcgtcgcggccgaaattgaagccggtatagtggtagtcgtcttcgtttgcgccgatgacccagtccgcgcctttttcggtagcgaaatcggcatagactttgcctgcaaaaccgacagggccgagagagccgccgtttgcgccgaactgttcgacaatcgcggcagggcttgccatcgtcagcggcgatttcacgcccgcgagtttctcggctttgatgtcgttaaattcatggtcgccgcgtaacagcagcaggataagttcgccttcgttttcgccttcaaccacgatggatttcagtgttttttcaatcggaatactgaggaaatcaaccaatgaatcaatggttttgacgtttggcgtgtgtactttgacgagttctgcctgagcggctgcacgttcgcctttgagcggcaaggtcggcgctaactcgatattggcggcgtaatcggaagtgtcgctgtatgcaatcacatcttcgccgctttccgccaacacttgaaactcgtgcgaaccggtaccgccgatgctgccggtatccgcagcaacgggtcggaacgccaagcctagtcgggtaaagatgcggcaataagcatcatacatatcttgataggtcgtctggagcgaggcatagtcggcgtggaaggaataagcgtctttcatcacaaactcgcgcgcgcgcatcacgccgaagcgcgggcgcacttcgtcgcggaatttggtttggatgtggtaaaagtttttcggcagctgtttgtagctgttgatttctttgcgcacgatgtcggcgatgacttcctcgcaggtcgggcccatgcagaaatcgcggtcgtggcggtctttcaggcgcagcagttctttaccgtaaaactcccagcggccggattcctgccacagctcggcaggctgcaccaccggcatcagcaactccacgctgcccgcgcgcgccatttcctcgcgcacgacgttttcgactttgcgtaacacgcgcagccccatcggcatccaagtataaagacccgatgcgttggccttaatcaggccggcgcgaatcatcagcttgtggctggcaagcgcggcttcggcaggggcttcttttaaagtagagataaagaattggctggctttcataaaagtatttttccaaacaggcaaattcaaaagtaaatcgggtgcagattgtaacgcgaaaaaagcaggttttgcaccaacctccaaaattcaccccctgccccaagcgcgggacaaatcccataacagacggcaaaaacatgaccagaaacatcatattgaacataagcacatgatttttatagatttaaatgtgcctattttttaatcaaaataagcgtacatttgttgcgtaagacttttttaacacaagccgtggcttatcaacacggttatccacaaagcttgtgtatagattttctacaataggaaaattgccgacagagacataatgattcgatataccacaattccgaaaaaatatcgccaaaatcaaacagaatatttcgaaatcaaaaagacttgaccttaccaaacgccaacttcagtataaaacctgcttttacaggcatggttatttgccagcagacccgattgctgataggatttcgtgtggagcagatcgaacatttttttcaagttttcccttgtttccaaaacttttataattttttgaaaacattaaacttaaattatttttttcggtttgatttagaaattttcgtttttgcttattatttttcacaaacgaaaataaaggggttggctacaccctccctgccgattaaacactcaacataaaggatagatactatgtccacccaattacacgatgttgaccctatcgaaacccaagagtggctggacgcgttaagctccgtcctcgaatatgaaggcggcgaacgcgcgcaatacctcttggaaaacctggtcaaatactgccgcgacaagggcgtacgtatgccacacggcacgaccaccccgtatttgaataccgtttcggttgaaaacgaaaaaggcattccgggcgaccaaaacatcgaacaccgcatccgcgcattcgtgcgctggaacgccgccgccatcgtattgcgcgccggcaagaaagatttggaactgggtgggcacatcgcatctttccaatctgccgccaccatgtacgaagtcggtttcaaccacttttggaaagccaaaggcgaaggcgaagaaggcgatttggtcttcttccaaggtcacgtcgccccgggcatctatgcacgcgcattcgtcgagggccgtctgaccgaagaccagctgaacaacttccgccaagaagtggacggacacggtctgccttcctatccgcacccccacctcttgcccgacttttggcagttcccgaccgtatccatgggcttggggcccatcatggcgatttatcaggcgcgtttcctgaaatacttggaatcgcgtggtttggcaaaaaccaaaggccgtaaagtatggtgtttctgcggcgacggcgaaatggacgaacccgaatctcaaggtgcaatcgcactggctgcacgcgaaggcttggacaacctgattttcgtcatcaactgcaatctgcaacgcttggacggtccggtacgcggcaacggcaaaatcatccaagaattggaaggcaactttgccggcgccggctggaatgtcgtcaaagtcatttggggccgccgctgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgacccgcaaaaagtgtacaacgcctacgaccgcgcagcgaaccatgccgacggcaaacctaccgtcatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcagcattcgacgcacaactcaaatccagcggtgaacgcgagttctcgaccacgatggcattcgtccgcatcctgtccactttactgaaagacaaaaaaatcggcaaacgcgtcgtacctatcgttcccgacgaaagccgtactttcggcatggaaggtatgttccgccaatacggtatttggaatccgaaaggtcagcaatatacccctcaagacaaagaccaactgatgttctataaagaatccgttgacggtcaaatcttgcaagaaggtattaacgaaccgggcgcgatggccgactggattgcggctgcaaccagctacgccaacagcaacttcgccatgattccgttctacatttactattctatgttcggtttccaacgtatcggcgacttggcttgggcggcgggcgatatgcacgcgcgcggcttcctgctgggcggtactgccggccgtacgacgctgaacggcgaaggcctgcaacacgaagacggccacagccacatccaggccgacctgattccgaactgcgtatcttatgacccgactttccaatacgaagtcgccgtcatcgtacaagacggtctgcgccgtatgtatgccaataatgaagacgtgttctactacatcaccctgatgaacgagaactacacccatccggatatgcccgaaggtgcggaacaagacatcttgaaaggtatgtacctgctgaaagccggcggcaaaggcgataagaaagttcaattgatgggctccggtaccatcctgcaagaagtcattgccggtgccgagctgctgaaagccgacttcggcgtagaagcagacatctggtcttgcccgtccttcaacctgctgcaccgcgacgctgtcgaggtagaacgcttcaaccgcctgcatccgctggaagccgaaaaagtacctttcgttacttcccaactgcaaggtcatgacggtccggttattgccgctaccgactatatccgcagctatgctgaccgtatccgcgcctacatcccgaacgactaccacgtcttgggcactgacggtttcggccgttccgacagtcgcgccaacctgcgccgcttctttgaagtggatcgctacaacgttgccgtggccgcattggccgcattggcggaacaaggcaaagtcagcaaagaaaccgttcaacaagccattgagaaatacggcatcaaagccgattcagctcctagctggaaacgctgattgatgtttcagacggcctgtttgccccattccgacatcaggccgtctgaaaaccgaatgcccgaatggtttgagcagacaaaccgtaccgatgccgcctgaagcagctttcagacggcatccaatgaaaaagattaaaggaactcaaatgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattctgaccgttgaaaccggtgccgccgccgccgaagccgccccggctgctgccgaagcacaacctgcacctgctgccgcacccgctgccgcaggcggtgcaaccgttcaagtagccgttcccgatatcggcggccataccgatgtggatgtaatcgccgttgaaatcaaagtgggcgacaccgttgccgaagacgacacgctgattactttggaaaccgataaagcgacaatggacgtaccttgtaccgctgccggtgtcgttaaagccgtattcttaaaagtcggcgacaaagtatccgaaggctctgccattatcgaagtagaaaccgtcggctctgccgcagcagcccctgctcaagccgctcaagctgccgcaccggctgccgctccgcctccgactgctgccgccgcacccgccgccgcgcctgcaccttctgcacctgccgctgccaaaatcgacgaggccgctttcgccaaagcacacgccggtccttccgcacgcaaactggcgcgcgaattgggcgtggatttgggccaagtcaaaggcaccggcttgaaaggccgtatcatgggcgacgacatcaaagcctttgtgaaatccgtgatgcagggcggcgcggcaaaacctgccgcagccagcgcatctttgggcggcggtctggacttactgccgtggcctaaagtggacttctccaaattcggcaatgtcgaagttaaagaattgtcccgcattaagaaaatttccggtcaaaacctgtcccgcaactgggttgtgattccccacgttaccgtacacgaagaagcggacatgaccgagctggaagaattccgcaaacagctgaacaaagaatgggaacgcgaaggcgtgaaactgtccccgttggcgttcatcatcaaagcctctgtttccgcgttgaaagcattccccgaattcaacgcctcactggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgtgaaggcaagctcaaaccgcaagaaatgcaaggcgcgtgctttaccatttccagcttaggcggcatcggcggcacaggcttcacgccaattgtgaacgctcccgaagtcgccatcttgggcgtgtgcaaatcccaaatcaaacctgtttggaacggcaaagagtttgccccgcgcctgatgtgcccgttgagcctgtccttcgaccaccgtgtcatcgacggtgcggccggtatgcgcttcaccgtattcttggcgaagctgttgaaagacttccgccgcattaccttataaaataaaacatccctctcaagcagtctgataatgtttggattgcttgagattgatgagtaatggtgttaaattcaacctttaaattaataacttatgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgcggttgaagtaaacgtgggcgacactattgctgtggacgataccctgattactttggaaaccgataaagcgactatggacgtacctgctgaagttgcaggcgtagtcaaagaagttaaagttaaagtcggcgacaaaatctctgaaggtggtttgattgtcgtcgttgaagctgaaggcacggcagccgctcctaaagccgaagcggctgccgccccggcgcaagaagcccctaaagctgccgctcctgctccgcaagccgcgcaattcggcggttctgccgatgccgagtacgacgtggtcgtattgggtggcggtcccggcggttactccgctgcatttgccgctgccgatgaaggcttgaaagtcgccatcgtcgaacgttacaaaactttgggcggcgtttgcctgaacgtcggctgtatcccttccaaagccttgttgcacaatgccgccgttatcgacgaagtgcgccacttggctgccaacggtatcaaataccccgagccggaactcgacatcgatatgcttcgcgcctacaaagacggcgtagtttcccgcctcacgggcggtttggcaggtatggcgaaaagccgtaaagtggacgttatccaaggcgacgggcaattcttagatccgcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcattggctctgaaagaagtaccgggcaaactgctgattatcggcggcggcattatcggcctcgagatgggtacggtttacagcacgctgggttcgcgtttggatgtggttgaaatgatggacggcctgatgcaaggcgcagaccgcgatttggtaaaagtatggcaaaaacaaaacgaataccgttttgacaacattatggtcaacaccaaaaccgttgcagttgagccgaaagaagacggcgtttacgttacctttgaaggcgcgaacgcgcctaaagagccgcaacgctacgatgccgtattggttgccgccggccgcgcgcccaacggcaaactcatcagcgcggaaaaagcaggcgttgccgtaaccgatcgcggcttcatcgaagtggacaaacaaatgcgtaccaatgtgccgcacatctacgccatcggcgacatcgtcggtcagccgatgttggcgcacaaagccgttcacgaaggccacgttgccgccgaaaactgcgccggccacaaagcctacttcgacgcgcgcgtgattccgggcgttgcctacacttcccccgaagtggcgtgggtgggcgaaaccgaactgtccgccaaagcctccggccgcaaaatcaccaaagccaacttcccgtgggcggcttccggccgtgcgattgccaacggttgcgacaacggctttaccaagctgatttttgatgccgaaaccggccgcatcatcggcggcggcattgtcggtccgaacggtggcgatatgatcggcgaagtctgccttgccatcgaaatgggctgcgacgcggcagacatcggcaaaaccatccacccgcacccgaccttgggcgaatccatcggtatggcggcggaagtggcattgggtacttgtaccgacctgcctccgcaaaagaaaaaataaatccgactgaataaacagccgataaggtttatttgagcaaatgccgtctgaaatgttcagacggcattttctattttacagcggattaaaatatcttctccgacctatagtggattaacaaaaatcaggacaaggagacgaagccgcagacagtacaaatagtacggaaccgattcacttggtgcttcagcaccttagagaatcgttctctttgagctaaggcgaggcaacgccgtactggtttaaatttaatccactataaaaacgaatccgacacggcttatctaaaggaatggttgaaaacggcagtttccaatacaacaaaatgccgcctgaacatttcagacggcatttgacccattactgctgcggctctgaaaccataccgccttcatcaaaatccggctccggttcgttttgcaacgttttaccgttcaatttcaactgattgtttttcagagaaatggcagtatcaatctggtcgccgttcaaagtcagatatttttcccttgccatactctgaaccgtactgtccaccatcaggcgcaaggtctcgttgatgtcgtcaagacttgccctgccttccgcctcatcttcggcattgacgctgaaaatattgcctgcttgactgaccgccaagtcttccagcattttttggggaatactcattctgatgtcggcttcggttttcttcagcatcaaacccaattgattcaaatcttccttcttcatgtctttaaacatgatttttccgcccacatcgatttttcccgatggcagcgtgaatcggaaagttttaatgtccaatacgggattgttggtgaacagtccggaagcctctcctttgacggcggcaatcaaatcattgcggatttgttcctcggtcatttttttggcggaaatttgtgcaaacttgcgtttcaatacggttaaggcagaagcatcgaggtgttcggcagcgatatggatgtccagcgggccgtatttttcatcgccgtacaccagtgtatcgaaacggaactgcccttcactgttgataaacgcgcctgattccccggtcttggttgaaaaagccagtttgccgacttcgattttggaaggtgcgatgctgccgttgggattgataaacgcgccaatctgcaaatcggtaacaagattgaccagttcgtttaacttgacgttgtaatcgacaccctctttccattctagggagaatttttccaaggtcagattgctgctgcccaaagcaagcggattgatgccgtctgaagtttccgaatcgaaatgcactttttcaaacgcggcatcgcctttgtctgccagcttgattttaaacaagggggcatcatagccgttccggtagcttttgaaacctttttgataaaccgtttctcccgtcaggccttcccagtgcagcctgatgcccgacagctcttcataatcgaaggcgggaacactgacttccattttaccgctgccgttaaaataaacggtattggcaagggaagccgggacttgttttccaaaaaagcgttccagaactttttccgtttcaggcgcgtatttgaactcggtttcaatgtacgcctgcgtgccgaatccgccggcgaaagggccgtgcgtgatatggttaaccagcgtaaccggctgttccaacactgttttcaggttatccggcaggtattttcgggcattattcagcaactcgggtttcagacggatgaccgtcgtttccatagaggtaaaccagccgcgctcatattggtgcgattcgacggtcaagaagcccgtttcctgcaatattttttgctgctgcgtcaagctttcttcggctttgacacccaaataataaggcgtgcccaaagcaacgccgagcaatgctgccgcaaccgaaatcaaaggttttttcatcacttcaaacaagcaggtttcaaagacgctagaatagcattatttaagcgtatcccgccatatctctttaaaagaaatgccgtctgaaacctgttcggacggcattttccggatatagggaaatcagaaatccaattccgccttcagccagtaagtgcgcggcataccgacgacggcgaagctgcggtcgtattggccgcgctgtacctgccaatagtttttgttgaacaggttttccaccgagctgctgacggtcagagtgtttttgccaagcttggttttgtagcgcgcgcctacgtcaatcaaggtataggacgggaaggcgtattgtttttgcgtgtcttggtcagacttgccgaaatacgaaacattaccgtttaaagtcaagcctttggcaaacggtgtatcccattccaaacctgctttggcaattacgcgcggattggcgacttgtacgccgttaaccagcatatcgcgtgaatttggatactctttcacggtcgattgcagatacatcagacccaaagtcggacgcaaagtattgttgagcaagttcgcgtaggtgttgaactcaataccgcgattgcgttccataccttgctcgtcgccggccgcgccgccttgcgccttatagcgggcgaaatcagaattattgccataggtcagcgttgttgttaccccttttgttgtcttggtagttgtatgaccgcgccagtagcccgggcgtttgatttggaacgcgtttaacgtggttacgaaattgccccagtttttacgcacgcccacttcaaactggcggctgacacgcggtttcgccattgtcgtttcgccggaatcatcggttttgatgtcggcaggctccaagtcttccatatagttgccgtacacaaccaaatcaggttgcggcacccacgccgccatcagcatcgggctgaaacgtttggcatcgccgctctgtgattttttgtcggtatattcgactgtttggaaacgtccgcccaaagtcaggcggtatttgttatccacgaagcccaaggtgtcggacaaagccaggctgttgactttgatattggcatccaagttggcagagttctcccaagaattgggatagtcggctgtaaacgatgccaattgatgctcaatatttccgtttgccttcacttctaccttgctagctccggctgccgttccgcgtgattttttcttattggtgtattcaaccgcttggaaacgtccgcccaaagtcaggacaagcgtccgccggcgttttgaatgtcctgcatacgcgcgcgaccgccgttggttttgcgttttgcgtagatggaatcgaacgctacgcgcagtgtttcgccgcgatagtcggcatttaccgcaaattctttgttgtcttcgctgtaaccgtggcgcggggtgtcgccgtggcgcagtttgccgttggcgcgcacgccgaatgctttgttttcgccgaaacgttggcccaagtcgaacgtaccttgggcgcggttgttgccgaaccgggccaaaccgattttgcggttgccttcatcagcggcttttttggtttcgatattgacggaaccggataccgcgccatcagggttcatgccgtttacggcggtggacgcgccttgaatcagttgtgcggagccgacttgcacgctggtcgtgccttgcgtgccgtacatacctgtcaaaccgttgacgctgaattggcgcgcatcaagctgataacctctgaaatacaatccggtcagcgtgttgctttcgccgccgaactgccaaacggaagcgtcttttttcgctacggcatccaccaaagtacgcgcctcggtgttgttgagggcttgttcgtcgtagttgacgacggtaatcggcgcggtaaaggcgttggctttgcccattcacttggtgcttcagcaccttagagaatcgttctctttgagctaaggcgaggcaacaccgtactggtttttgttaatccactataaacaaatcgtacagggttctccgtttaatcagatatgggtttccatcttcggcagtttcgggcatttagccgtttccaccttcctgcccccgctgccagtaaaaatgccgtctgaaatatcggcgcgatacttcagacggcatacccgcccgttttcccgcattcccgggagcgggctgaaatttaaacgtgtgcggaaatgattttcaacatttgcgccagcactttgggattggcagccacaatatcgccgctttccagccagccgtcttcacccgacatatcggttacgataccgcccgcttcctgaacaatcaatgcaccggcggcaatgtcccacggtttgaggttaaactcgaaaaagccgtcaaaacgtcctgttgctacggcgcacaaatccaaagaagccgcaccttcacgacggccgccggcggtttttgccaagaaatctttcaaaatcgccagatacttgtccatcatgctttgatcgacaacagggaagccggtaccaatcaggcagcggttcagttcgatgcggttggaaacgcggatgcggcggtcgttgagcaacgcgcctttgccacgcgaagccatatatacgtcgttgcgttcgggggcgtaaaccaaagcttcttgcaacacgcctttgtgcagcagcgccatagagatggcgtattggggatgaccgtgaaggaaattggtcgtgccgtcgagcggatcgataatccattcgtactcggctgcggctttgccgtgggagccgctttcttcacaagtgattttgtggtgcggataggcttctttcaaagcctcaaccaggatgatttcggaattgcggtcaacatcggaaacaaaatcgttgaaggctttgctgtcggttttgacggcatcgagattgcccgcggcgcgtatcatcatctgaccggcacggcgggcggctttaaaggctgtattcaaaaacggattcatcagatttccttaagggtggcataccgccggttcggacgtacagtccttcggagcggcaaaatcggagtttatttggttggggtaaatcctgccaaatcgggtaaaataccgcctgacgcgtgtctgcttcaggcgcaacgttaaatttccgacgttgttaaagaacatttcagacggcatttgaccgtccgaacgaaaaagacggcgcattataccctattccattccgaccgaaaaccgaacatgactactctcaaacccgccctgcccgcttatctggacaacatccgcatcatcctcacgcgcaccagccatcccgccaacatcggctctgccgcgcgcgcgatgaaaacaatgggtctgcacaaactgaccatcgtcgccccaaatctgatggcaacgccgatgacggaaaacccgcccgtgtttgacccggagcatcctcaatcgtttaaattaccggaagaaagcttcatcctcgcttccggcgcggcagacgttttggaaaatgccaccattgccgcttctttggacgaagcccttgccgacaccaccatcgcctgcgccctgaccagccgccgccgcgaaattactgcgccgctgcaaaccccgcgcgatttggtatccgaattactgcagaccgcaaaccgaggcgagaaagtggcactggttttcggcaacgagactttcggcttgagcatcgaagaagtccaagcctgcaaccgactgatgaccatcaacggcaatcccgactatttctcgctcaacctcgcccaagccgtgcaggtcgtgtgctacgaaatcttcagccaaaccggttcgcccatgacccatcttcaacaagaagaccacgctgcgacccacgagcaaatcaaaggcatggtcgcccacatggaaagcgtgatgaacgacatcggctttttcaaccgccgcaacggcgagcgtctgatgcgccgtatgcagagcctgttcggccgcgccaatacgcaaaccgaagacatcgatatcctgcgcggttttttcaataccgtcagccaccgtatccataaaaaagactgattaaggccgtctgaaaacatttccagcttttcagacggcatgactgatattcggataagcatgaattacgccctagacgcattatggtggaaacttaccagccaacccgtccgcgaccttgcctcgctgctgactgcgccgcctttgtggcaaagcggctgcgaattgagcgtgcgagaactactgggagaacacggtttccgttaccttttggcattggatgccgatcccacgcggctgacggattacctcgcccaacgcgccccgttcggccaccgtctcggcatttatgccgaagagctgctggctttttggtttgccaatgcaccgcacgccgaactgctcgcgcacaacctcacggtttccggttcggacggcaatacgcaaggcgcggcggattttgtggcaaggcttaacggcaaaccctaccatatcgagctgacctgcaaatattacggcggcgacacggacagtcccgaagggatgcgcggattcgaccccaaagacacgctgttgggaaaagccgccaaactgaccgcccaactcggtctgccgcacacttcagacggcatccggaccttgcggcagcacggtttgccgcttaacgtaaaacccgtttccatcgtgcgcggcatcggattttttccacacggtttccatgcttttgagccaccgcttaatccatacggttggcgcggcatctatattcaagattgggcggaatacgggtttaaacgccaagaagtccgctaccatctgctcgaccgtatggcctacctcgcgcctgcgcgtgtcgccgaaaccgaaacattgaacgcaaccgaaatccgccgtatcgaccaaggcttgattgccgttttggaatgtcggccggacggcttttggcacgaaatcgaacgcattatgaaggccgtctgaaaccctttcccaacattaacgcgtatatctattgagaggcttagtgatggaaatctcatttcccatacaatttatgaaagagtcatccgagttaataaggatattggatatgataaatataacaacaacatgccaactaatattatgacgatccaaacaaataagtatggtaatttaataactacgaccccaggtagaatacaatgaagaataatgttaaaaattggacaactaaagaagtcaagcaatcattagataaatttaataatattttaattaaaaatacttttcttcttcagtatctgaaaaaagagttttcagcttcaagtgcttattgtttgtctatgctccctgaagaagaagatatatatgaaatattggttaatgggaatattattattgatttagaatttaataaacatacaaatgaaacagttgttattaatgttactgatgttgatgaatacttgaaaactttaaccaatgagagtggtagagtattttttacattagcaaaagaaatcggcaaacagaaaaacatttaacaagagcgaaatacaaattaaaaactcaatggagtgatggcatatttaggatagatatactgaacgaagaaaataaattttgtttttttcctcatgttttagggagtgattacaaaatgaaatcgctgatgtgattatatcggatgctgttcaagcgacctgaaaatagaacttttttcaggctgcctttgtagttaacggagaaatttagacaaatcccgattgcgcacttttaacacatctttcttattgcggatagaatactaagtaatgataaagatgctattgttattttaaggacgttagattgattatgaataacccacagtaagagaacccattacattatgaacgccgcacaactcgaccataccgccaaagttttggctgaaatgctgactttcaaacagcctgccgatgccgtcctctccgcctatttccgcgaacacaaaaagctcggcagtcaagatcgccacgaaatcgccgaaaccgcctttgccgcgctgcgccactatcaaaaaatcagtaccgccctacgccgtccgcacgcgcagccgcgcaaagccgctctcgccgcactggttctcggcagaagcaccaacatcagccaaatcaaagacctgcttgatgaagaagaaacagcgttcctcggcaatttgaaagcccgtaaaaccgagttttcagacagcctgaataccgccgcagaattgccgcaatggctggtggaacaactgaaacagcattggcgcgaagaagaaatcctcgctttcggccgcagcatcaaccagcctgccccgctcgacatccgcgtcaacactttgaaaggcaaacgcgataaagtgctgccgctgttgcaagccgaaagtgccgatgcagaggcaacgccttattcgccttggggcatccgcctgaaaaacaaaatcgcgcttaacaaacacgaactgtttttagacggcacactggaagtccaagacgaaggcagccagctgcttgccttattggtgggcgcaaaacgaggcgaaatcattgtcgatttctgtgccggtgccggcggtaaaaccttggctgtcggtgcgcaaatggcgaacaaaggcagaatctacgccttcgatatcgccgaaaaacgccttgccaacctcaaaccgcgtatgacccgcgccggactgaccaatatccaccccgaacgcatcggcagcgaacacgatgcccgtatcgcccgactggcaggcaaagccgaccgtgtgttggtggacgcgccctgctccggtttgggcactttacgccgcaatcccgacctcaaataccgccaatccgccgaaaccgtcgccaaccttttggaacagcaacacagcatcctcgatgccgcctccaaactggtaaaaccgcaaggacgtttggtgtacgccacttgcagcatcctgcccgaagaaaacgagctgcaagtcgaacgtttcctgtccgaacatcccgaatttgaacccgtcaactgcgccgaactgcttgccggtttgaaaatcgatttggataccggcaaatacctgcgcctcaactccgcccgacaccaaaccgacggcttcttcgccgccgtattgcaacgcaaataaaccggtttgaacaaaatgccgtctgaacccttttcaaagcgttcagacggcatttcatcaattatagtggattaacaaaaatcagtacggcgttgcctcgccttagctcaaagagaacgattctctaaggtgctgaagcaccaagtgaatcggttccgtactgtttgtactgtctgcggcttcgtcgccttgtcctgatttttgttaatccactatatttttgggaatctgttttaccccaatatataaagcaccatattaaggcggagtgtcttccccactttgacccgaacccggaaaagacaccgcccaagccaatcctgatgctgccccgacagccaaccattaaggaaatcctaatgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaatcggctctagcgcaaacccgatgccgtctgaagcggcacggggtttgtcatttctgccagtaggttttgacgttgacgaactcgtacagcccgaattcggacaattcgcgcccgtaaccggaatctttgactccgccgaaaggcaggcgcaaatcgctgctggtatggcggttgataaacaccgatcccgcctgtattttttcggcaaaccgccaagcgcgttcggtatcggcggtataaatgcaggcaccgagcccgaacggggaatcattggcaagggcgatggcatgttcttcgttttcggcgcgcaaaatcagggcggccggcccgaatacttcttctctccagacgcggcaggcaggatttaccctgtctaaaaccgtcgcgggataaaaccagcctcgcccttgtgggatttttccgccggtcaggcataccgcgccgtttgaaacggcatcttcaacctgcccgtgaaccctgtcccgcaaatcttcgcggtgcagcggtgcaagcgtagtatcgggatgtttggggtcgcccattttcaatttagcgcattcggcaagaaacagcgtgataaaacgatcggctgcggcttcggttacgatgatgcgcttggcggcgttacacgattgccccgcatcgcggaaacgggaataacaggcttctgcggcggcacgctccaaatcagcatcgggcatcacgataaaggcgttgctaccgccgagctccaacacggttttcttaaggtttgcgcccgcgtgtgccgcaaggatgcgccccgtatgcgttgaaccggtaaacgccattgcatcggtatcttcaaccgccttgagcgtgcccgcctcatccagccacacgcctgccagaggaatgccgtctgaagccaaatcgaacagtgcctgactgacgcgtgccacgctgggcgcgggtttgacggcgcacgcgttgcccgcgcacatagcgggaacggcgaaacgcaatacctgccagacgggatagttccaaggcatgacggcaaacaccacgcccaaaggctcgaagcgcacctgactcaaactcgcctgcgtcgcgatggttttgtgggcaagcagttcgggggcaaggcgggcgtaatagcgtatcagttcgatagacttgccgatttccgcacggcattcgtgcaagcagcgtccgacttcctcacacaccatttccgcaaaacgctctttctccgcctccaaacggtcggcaaatttttgcaggcgcgcggcacgttcggttacgcccagttgcgcgaacgccccgccgcgcattttcaaatccgccagccgccgttcaaactccgcataatcttgagcggggcggcggtaaagcgtttcgcccgtaaatacattgacactgtgaaacatcgaatcaacctgccagttgcgggaatatcgttttcagtcccgacacaataatctccaccgataccgccgccagcatcatacccataatgcggtttaaaatcgtcagccccgtcgcgcccagcaggcggctgaccttcccggcaacgattaaaatggcataacaaatcgcactgaccaccaaaccggccgcgataatcaacgcgatgtcgccgtatgttttagccgccgaagcgtaaataatcacggtcgaaataccgcccgggccgatggtgatcggtatggcgatgggcacgacggcaatcgctccggcattgcgggcggggcgcgcctgccccgtttccggctgcgcgccgagattctgcttggcgggattgtcgttgccgttcatcatcgaaatggcgatcagcagcaccaaaatcccgccgccgacctgaaacgaaccgacgctgatgcccaaaaccttcagcagcgtaccgccgatcagcgcaaataccgcaatcacggcaaacacggcaacggcggccgtccgcgcgaccttcctgcgctccttcgtgctgtgcccgttggtcaggtcaaggtaaagcgacaacgcgctaaacggattaatcagcaccaaaaaagccacaatcagcttgccgatttccatgcccaatcccattatttccccctccttcaaacccgtgcggcaggcatccgatgctgcaaattgccgccgcaacggatttttccgttataattaaaaattcaagcaatacgccccatcatacccgaacgacggtatctttaccatcagacaaggatgcttttcatggcactgacacttgccgacgtagacaaaatcgcccgactctcccgactgcacctgactgcggaagaaaaagaaaaatcgcttcaagaattaaacgacattttcactatggtcgaacagatgcaaaccattaacacagacggcatcgaaccgatggcgcacccgcacgaggccgccctgcgcctgcgcgaagacgaagtaaccgaaaccgaccgcgccgccgaatatcaggcgggtgctccggaagtacgcaaccgtctgtacatcgtaccgcaagttatcgaagaataatccgaatatgcttcagacggcatcagcaataccgcccgaagccctttaaggatggaagatttatgacccaatacacattgaaacaggcaagcgtcctgttgcagtccaaacagatttccgccgtcgaactggcaagcgcataccttgccgccatcgccgaaaaaaatcccgccctcaacggctatatcaccatcgaccaagataaaacccttgcagaagcccgtgccgccgacgaacgtatcgcgcagggcaacgcctccgcgcttaccggcgtacccgtcgcctacaaggatattttctgccaaaccggctggcgcagcgcgtgcgcttccaaaatgctcgacaacttcatctccccctacaccgccaccgtcgtccaaaacctgctcgacgaaggtatggtaacgctcggccgcaccaatatggatgagttcgctatgggttcgaccaatgaaaactcattctacggtgcagccaaaaacccatggaatcttgagcacgtccccggcggttcgtcaggcggttccgccgccgtcgttgccgcgcgcctcgcccctgccgcgctcggttcggacaccggcggctctatccgccaacccgcatcgcactgcggcattaccggcatcaaacccacatacggcacggtttcccgcttcggtatggtcgcctacgcctccagcttcgatcaaaccggcccgatggcgcaaactgccgaagactgcgcgattctgttaaacgcgatggcaggtttcgaccccaaagactccaccagcctcgagcgcgaaaaagaagactacacccgcgatttgaaccaaccgctcaaaggtttgaaaatcggcctgcccaaagaatatttcggcgaaggcaacagcgccgatgttctgacggcattgcaaaacaccattgatttgctgaaagcccaaggcgcggaattgattgaagtttccctgccgcaaaccaagctgtccatccccgcctactacgtcctcgcctccgcagaagccagcaccaacctttcacgttacgacggcgtacgttacggacaccgtgccgcccaattcgccgatttggaagaaatgtacggcaaaacccgcgccgaaggtttcggcagcgaagtcaaacgccgcatcatgatcggcacttatgtactgtcgcacggctactacgatgcctactatctcaaagcccaaaaactgcgccgcctcgttgccgatgattttcagacggcatttgcacggtgcgacctcatcctcgcgccgaccgcacccactgcagccccaaaaatcggagcggatgcttcgccggttgaaacctacttgagcgatatctacaccatcgccgtcaacctcgccggactgcccgcattgaccctgcccgcaggcttcagcggcggcggactgcccgtcggcgttcagcttgtcggcaactacttcgccgaagccaaaatcctcggtgcggcgcatcaaatccaactcaacagcgattggcacggcaaacgacccgaatgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcatcccctatccgtcaggggctgttcctccactgcccgcaaaatgcctatccgctgctgcgcgaatttgttgacaggcgttttaactgcaaacgccgtttagatgcgatgacggcagattttctcatggcggaaaaactgttcggcacagacatcctgcaccaaatggaagactaccgcttccatttggtcttggcgcacctttcagacggcatcagcttgtggctcaaccgcaacgacaactgcgtcgaagaaggcgcgtggtctttatctttgcgcgacgaagcaggcaaccggctgtatatggcgactttcgcctttgtcggcacacacctgctgacagcctccgtacaagggccggcgggtgaagaagccaaagacaccgtccgccgcataaccaaacaactccacggcttgcgtccccaacaactgatggtaaccgccctgcaatatttcgccgccgtactcggcttggacggcgcaatgggcattgcacaaaaacatcaggtcaaactgcgctggaaacttaaaaagcgcgtcaaaatgaattacgacgcattctggcaggaatacggcgcaagtttggaacgggacggctactggcatctcccccaaacccccgcccgcaaagaccttgccgacatcgaaagcaaaaagcgttcgatgtaccgcaagcgttatgaaatgctggacaatatggttgcagagatgaaagacagtctgaaaacagaagcacgcggcatttcagacggcatccaaacggaaaaaccgccccgccggacagcctgacgcgaagactatcgaattgatattttagagaaagaagctcttatgacctgggaaaccgtaatcggcttggaaatccacgtccaattgaacaccaaatccaaaatcttcagcggcgcatcgaccgcattcggcgcagaacccaacgcgcacgccagcgtagtggaatgcgcgctgccgggcgttttgcctgtgatgaaccgtgaagtcgttgaaaaagccatcaaattgggtttggctttagatgcgaaaatcaatcagaaaaacgtgttcgaccgcaaaaactacttctatcccgacttaccaaaaggttatcaaatcagccagttggacttaccgattgtcgaacacggcaaattggaaatcgtagtcggcgacgatgtgaaaaccatcaacgtaacccgtgcgcacatggaagaagacgcaggcaagtccgtgcatgaaggcttgaacggcgcaaccggtatcgacctgaaccgcgccggcacgccgctgttggaagtggtatccgaacctgaaatgcgttccgccgccgaagccgttgcctacgccaaggccttgcacagcttggtaacctggctggacatttgcgacggcaatatggcggaaggctcgttccgcgtcgatgccaacgtatccgtgcgcccgaaaggtcaagaagagttcggcacgcgccgcgagattaaaaacctcaattccttccgtttcttggagcaggcgattaattacgaagcggaagcgcaaatcgagattttggaagacggcggcaaagtacagcaggcaaccatgctgtttgatcccgaaaaaggcgaaacccgcgtaatgcgcctgaaagaagatgcgcacgactaccgctacttccccgaccctgatttgctgcccgttatcatttcagacgcccaaatgcaaaaagccaaagcagaaatgcccgagctgccgaaagaaatggcagcgcgtttcgtggcggattacggcgtgtccgaatacgacgcgcgcctgctgaccgcaagccgtgcgcaggctgcctattttgaagaagccgccaaagaaagcggacaaggcaagctgactgccaactggatgaacggcgaacttgccgccgcgctgaacaaagaaggcatggaacttgccgacagcccgattaccgccccgcgcctcgccgcgctggttggcaaaatcgccgacggcacattaagcagcaagttagcgaaaaaagcctttgaagccatgtgggcagaacccgaagccaccattgccgaaatcattgaaaaacacggtttgcaacagatgaccgacaccggcgagattgaagccatggtggacgaagtgctggcaaacaacgccaaagccgtggaacagtttaaatccggcaacgaaaaagccctgaatgcgattgtgggacaagtgatgaaggccagcaaaggcaaagccaaccccgcgcaggttcaagagctgattaaagccaaactggcttaatccgttatcacacaggtcgtctgaaagcaaagttccaacgaaggtaaaacaggaaataagctttcagacggccttttatagtggattaaatttaaaccagtacggcgttgcctcgccttgccgtactatttgtactgtctgcggcttcgtcgccttgtcctgatttaaatttaatccactataacttaatctgctcaaaccataccaagacatgaaccacaccgttaccctgcccgaccaaaccacctttgccgccaacgacggcgaaaccgttttgaccgctgccgcccgtcaaaacctcaacctgccccattcctgcaaaagcggtgtctgcggacaatgcaaagccgaactggtcagcggcgatattcaaatgggcggacactcggaacaggctttatccgaagcagaaaaagcgcaaggcaagattttgatgtgctgcaccactgcgcaaagcgatatcaacatcaacatccccggctacaaagccgatgccctacccgtccgcaccctgcccgcacgcatcgaaagtattattttcaaacacgatgtcgccctcctgaaacttgccctgcccaaagccccgccgtttgccttctacgccgggcaatacattgatttactgctgccgggcaacgtcagccgcagctactccatcgccaatttacccgaccaagaaggcattttggaactgcacatccgcaggcacgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgctggcaaccggcacaggctacgcccccatccgcagcatcctgctcgaccttatccgccaaggcagcaaccgcgccgtccatttctactggggcgcgcgtcatcaggatgatttgtatgccctcgaagaagcacaagggttggcatgccgtctgaaaaacgcctgcttcacccccgtattgtcccgccccggagagggctggcagggaagaaatggtcacgtacaagacatcgcggcacaagaccaccccgacctgtcggaatacgaagtatttgcctgcggttctccggccatgaccgaacaaacaaagaatctgtttgtgcaacagcataagctgccggaaaacttgtttttctccgacgcattcacgccgtccgcatcataattccccggtataaagaggattcgagctttccgttcagaacacaaaaaacttcccgtccgtgttttccccgtgaaaaaatgccgtctgaaacccgattccggttttcagacggcatatgttttttcctgttcaaggcgacagccgctcgcgtatccagccaccatccagcaaacggtattggatgcggtcgtgcagcctgctcggtctgccctgccagaactcaagcaaatcgggaatcacaatatagccgccccaatgcggcggacgcggcacatgcagaggatgtttgagtccaaccgccgccgcctttgccaccaataccgccttgttcggaataacctcgctctgcgcacttgcccacgcacccaaacggctctgatacgggcgactctcaaaatattcgtccgacaacttctccgccagcctttcaacacgcccttccacgcgcacctgacgctccagctccggccaaaaaaacgtcatcgccgcaaatggatgagcatccagcgaacgccccttgcggctgtgataattcgtaaagaaaacaaaaccttcagaattaacttccttcagcagcaccatacggctgttgggcctgccgcgtccgtcaaccgccgccacattgaccgccgtcggctcgttgacctgtgcgcgtaccgcctcgtccaaccaccgctcgaactgctcgatcggattatcggcgcaatcggcttccgacaattcccgtttgctgtaatcttcccgaatattgtgcaaatccatttactgctcctcttatcatttgaaagattctactcccgcacgcaaaccgatttcaaccgtcgcacaaactttgccccgaccccaagccgcagcgacgatttcatccgcaaaaccgccgcatcaggtacaatatcgaaccgtccgaccgaggacggcattttatcaacccgtcctgccgcacacgccgcagaagaaccgccttatcaggcgagttaggaaaaatgatgtccaaacagcccaccagcaaacgccaatggcgcgacggcgcagccccgtctgccaagaaaaccgccaaaccgttcaaaagcaaagcccgtcccaaagatgaaacgggcaaaaccgcttcccaaccttacggacaaaaagcttcagacggcatcaaacctcaaaacgtccccaaacagcgcgccgccaaagccaaaaaactcgtcgtccgcaatcccaaccaaaaaattatggaacacgcgcgcgatttgaaagaacgccgcagcgacctgtcgcgcatggaacccgaacgcctgcaaaaagtgcttgccgcgtccggcgtcggctcgcgccgcgaaatggaagaatggattaccaacggctggataacggtcaacggcaaaaccgcgcaactgggcgacaaagttacccccgacgaccacgttaccgtcaaaggcagcatcatcaagctcaaatgggcggaccgcctgccgcgcatcatcctgtattacaaacaagaaggcgaaatcgtttcccgtgacgacccgcaaggccgcgtcagcatattcgaccgcctgccgcaggccgccagcagccgctgggtcgccatcggacgcttggacatcaacaccagcggacttctgattcttaccacctccggcgaactcgtccaacgtttcgcccaccccagcttcgaagtcgaacgcgaatacgccgtgcgcgtcttgggcgggctgaccggcgaacaaatgcgcgtcctcaccgaagaaggcgtgatgctcgaagacggcttggcaaaagtcgaacgcatccgcgaacaaggcggcgaaggcgcgaacaaatggtacaacgtcgtgattaaagaaggccgcaaccgcgaagtgcgccgcatttttgaaagccaaggactcaccgtcagccgcctcgtgcgcatcggcttcggtcccatcggactgcccaaccgcctcaaacgcgggcagttctacgaactcaaccccgccgaagtcgccaacatcatcaaatgggcggacatgctgctgccgggcgaacgccgccgcaaaaaagcctaaacccgccaaaacacaaaaatgccgtctgaaacatctgctgtttcagacggcattttattcgggcgttttcaggagaaaaggtcgagtgctttgacaaagaccatcaccacgccgtaggcgagcggtatgacggccaatgcccaacgccaccagaccgatatgccgccgccggaaactttttcgcccacaaggtaagcgtcggatatggcggtttcgtcatcggggttgccgctgtgtgcggcggttttgatgtctttttcgtggtgtttttcgtgtacggatttgacggcgaggttgcacaacaaaccgataatcagcaggcacgccatgatgtacatggttacgctgtatgcctgtgccgccggtatgccgctgtcgatttggctttggcgtatgtaattgaccagtaccgggccgatgacggcggcggttgaccaggccagcaggatgcgtccgtgaatcgcgccgacctgataggtgccgaacaggtctttcaggtaggcgggaatggcggcaaatccgccgccgtacatggaaataatcacgcaaaagccgatgatgaacagggctttgctgccgccctcgccgatggagggaacggcgaaatacagcagcgaaccgagtacgaagaagatggtgtaggtgtttttgcgtccgattttgtcggaaacgctcgaccacaaaaagcgtccgcccatgttaaacaggctcaggaggctgacgaagcctgccgccgcacctgcgccgactgctgcctgcctgcctatggaggtttcggaaaagagttcctgaatcatcacggatgcctgacccaatacgccgatgccggcagttacgttcaggcacaatacccagaacaacagccaaaactgcggcgttttcatggcttgggacacgttgacatgattgctgctgaccagcttgttttgcgttttcggcgcggtatagccttcaggtttccagccgtcggcaggtacgcggatggtaaacgcgccgaacatcatcagtgcgaggtaaagcagacccaatacggcgaaggtttcggcaaccccgaccgaagcagcgtttgaaaaggtgttcatcagtgatacggaaagcggcgaggccagcattgcgccgccaccgaaacccataatcgccaaaccggtcgccatacccggcttgtcgggaaaccatttcatcagtgtggaaaccggcccgatgtagcccaaacccaagcctacgccgccgatgacgccgttgcccaaatagagcaggaagaggttgtgcgtacgcacgccgaatgcggatacgaagaagcccaggctgaagcagcaggcggcggcaaatatggctttgcgcggccctacccgttccatccacgtaccgaacagggcggccgacgcgcccagcatcgcgagtgcgatactgaaaatccaacctacggtcgtcagcttccaatctccggccgccgattcggttatgccgataagtttggtcagcggcgcgttgaatacggaataggcgtaaatctgcccgatggcaaggtgtaccgccaatgctgcgggcggtacgagccaacggttgaaacccggcttggcaatgcttgcctcacggtctaaaaacttcataacatcctctttctgtcagttgaaaaataaaatttcatttgcccaatggaaacttattgaaaattataaaaaaatatcgggtcgggtttttatccgccccaagatgcgccgtctgaaacatttcgggtgtacggaaaggtttctgttttttccgacaaattcctgcggcttttcgcttccggattcccgctttttcaggaatgacgaattaaagattatcttaaggtcaagggactggattcccgctttcgcgggaatgacggcggcgggggagcggtttttccgattgggtttaaatgcaatcgaacaaatcctgctgcccttgttctttgcttacgcgcacgtcggtttcgccgtcggcgaagataatgtgcagcttctgcccctgcttcaaaacatcggcgttgcggatgacttgtccgcgtgtgtttttgacgacggaaaagccgcgctccagaatgtgctgcggcgaaacggcttcgagcaatgcggcttgggcagtcaggctttggcggcggtgggtaagcagttggtggaaggcgtgcgacagggccgtctgaaagcggtcgatgttttttttgcaaacggaaacatcaggacggcaatgtttcagggcttgggtttggcgttcgaaacgggcggtgtgggtacggacgttttgcgtcatcgagtaagacagcgtttgcgccagcttgccgattgaagcgcgctgttcgtcgagtttttggcgcggatgacggatttgccgcgccagccagtcgagtttttggctggcatcgaaatagcgttgttccaaaacggttttcagacggcattgggcttgggcgaggcggtgcagcgattcttggcggttggggctgaccagttccgccgcaccggtcggcgtgggcgcgcgcatatcggcgacgaaatcggcgagcgtgaaatcggtttcgtggcctacgccgctgacgaccggaaccgtgcaggattcgatggcgcgcacgaccggttcttcgttaaacgcccacaagtcttcaatgctgccgccgccgcgacagacaatcaacacatcgcattcggcgcgttgcgaggcggttttaatcgcttgggcaatttgcaattcgctgcctgcgccttgaacgggtgtcggataaacgataacggggatttcgggtgcgcggcgtttcaaggtagtaacgacatcgcgcaaagccgccgccgccagactggttacgatgccgatacattgcggacggacgggcaaaggtttcttgcgttccgccgcaaacgcgccttccgcctgcaactgcgccttcaaccgctcataggcttcgtaaagctgccccaaacctttgagccgtacttcgtttacggtaatctgaaattcgccccgcgcttcataaatactgatttttcctgatacctcgatatggtcgccttctttcaaaggcttcgccaaacgcaccgccgcacccttgaacatcgcgcaacgcacctgtgcgcggctgtctttgagcgagaaataataatgcccgctggcggcacgggtcaggttggatacttcgccggcaatccacaaaccggcaaggtggttttccaaaagacttttggcaaatgcgttcaactcggaaacggacaacacgtcagaatgaaaaaaatcagacatcgaatcaatcaaatagtaaaaaatatgaatatgttttgaagcctaaggcggcaccgggccgcctaaattgtcaacaatattataacacgcgccatcttgccgcccgccttttcccgtatgacttttttaagcggggaatgggaaaaatattcatcaacctgcctgcaatctattcaaattgcaccgccggcaggctatgatgcggatattttcgacaggaggaaaaatggatacgcaggcagttatcacacatatcgcccgatggttggacgaatacgccgcccgggcaaatgcaaaagggtttgtcgtgggcgtttccggcggcatcgattccgccgtcgtctccgcactcgccgcccgcaccggccgccccacgctgcttctggatatgccgatacgccaacaccccggccagcttgagcgggcaaggctgcacatccgcaatctgcaacggcaatatgccaatgtaagcgcgcaaacggtcgatctgaccgacaccttccagacctttgaacaaaccgtcggtgctcatcagacggcatttgacagtcagccgctttccctcgccaacgccagaagccgcctacgtatgctgaccctgtactactacgggcagatacacggactgctggttacggggacaggtaataagattgaagatttcggcgtgggcttttttactaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaagaacagatgggcgcaagctatcccgaactggagtgggcaatgggcgtgtacggcacgcgcaaacccgaagattttgaagggcggcagcgcgaagttctagaaatctatacgcgacttcaccgcgccatgcagcacaaaatcaacccgattcccgtatgccgcattccgcccgaattgctgggctgaaacacggaaatgccgtctgaaacggaaaaccgtatttcagacggcatggaaatatccgactcctatcccttaagaatcgagtacgcgggcaaacaaaatatcgttttccaaatgaatgtggtcgttcaaatcctccaccatttctttcgccagcgcgtaaagccgcgtccagcttccgcaagccccttctggcggttggaaattgtcggtcagctctttgagccgtgcgatggcgcggtcgtgttcttcgtgttcgtgcatcatcacgccgatgggcatcgccgcaccgcgtccgacaccctgattaatcatcggaaacagcatcctttcctctttcatcatatgcatcagcagttcgttctgcatataggcaagcagctcggcaatttccgccggaaaggtgtcggcatgaacttgggccactttttgcgccagcggcaccaattcttcaaattgtgcacggtggacattgtggtagcgttgcaggatatgatcgacggttgcaccaaagggggcggtctcccaaacggaaaaatcagtcatcgcagtgttccttttacagggtttcgggtttggttttgaacattcatactttaagaatcaattcaaacggagcatacaccgcccgcgcgcttctgtacagcctcaaacgtattccttacattttgataataaaagtaattttcagaaataaaatactgtccgaaccgttttttagaatttgcaaaggcgattggggcggtacagaaaaactattatcccgcccgcccacttgaaatttttatgcccaagccctatcctgcacgctatcgtgccaatcccaaccgaaaaggaaaaataatgagcagcgaattgattgtacacaccagcgatgccgcttttgaaaaagacgttttaaatgcagatatccccgtcctgctggacttttgggctccgtggtgcggcccctgcaaaatgattgccccgattttggacgacattgccgccgaatttgaaggccgtctgaaagtggtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaagcctctatcgcctgataaagcgcaatcgaaaaagccgccggaagattccggcggctttttcgcacccttaagatttgtggcggatttcccagcacctatggatttttttgttgcggaaatcttcgggaacggattgtttggaaatgtctttgacggcgtattgttccgataccaagtcgtctaagacgaagctgcgcaggttgttggaaaagtacaaaatgccgtctgaagcgagcagcttcaccgcgccgtcaatcagctttttgtggtcgcgctggatgtcgaggatgtcggacattttcttgctgttggaaaaactgggcgggtccatcacaatgaggtcgaaccgcctgccttccccatatgccgtctgaagatattggaacacgtcggcgcggacgattttgtgtcgttccgtatcgatgccgttcaattcaaaattgcgtttcgcccaatcaagatatgtgttggacaaatcgacggtttcgctggatgccgcgccgccggtggcggcatagacggtgaagctgccggtgtaggaaaacaggtttaaaaaacgtttgcccgccgccgtttcgccgacttttttgcgcgtgtttcgatgatccaaaaaaagccccgtatccaaatacttatcaaggttgacccaaaacttgcggccgttttcggtgatgacgaaatcgtcgcccgccttgccggttttctcgtactgctgcaaacctttttggcgttcgcggcgtttgaggcggatttgttcgggcgcaaaaccggtaacgaaagcgacggcttccaagacttcggcaagccacgcttcgtattcttcgggccgcatcagccagccggtatcgtattcctgaaggtggattcgatcgccgtaaacatcggcggcaaaggggaattgggggatgtcgcggtcgtaaatgcgccaggcttcgatgccgttgcgtttcgcccatttcataaggtgtttgatgtttttgcccaagcggttggcaaacggtgtgatgtcggtcattggtttcaggcggaataaagtggaaaacggcaattttactgtaattaacgcccgattgcttgaccgtttcgggcaaaccctataccatccgtcgcttatcttgtcatacgaagccatcgccttccaacctaaaccgcccttacgggcgcgtttcttctgttgctttgattttgcaaagcatatctgtgcaggttgccgtcgatgtaaaccacaagcaagccgcttgcgacaaccctgtaacttcacattccccgtatcgttacccttccctgcttcaggccgtctgaacctttcggacgcgggcgttgttgtcttccaaggatagccatgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaagccccaacctgccgcataaaccaatgccgtctgaaaccgatttcgagtttcagacggcatttttgcaatgtttcagcaccgcccggctttgatacccaaaggattaggctgtaataaaaacccttttccgctttggcaacgattgaaaatttccgtaaattcaaatatctagattccttcctgcacgggaatgacacggaagggtttcagatgcagggtgggcattcctgcccacccaatcccgcccttgcaacggtgggcaagaatgctcgccctacggcttgactgttcgatatgatgccgtctgaaaacccaacggcggcatgacaatgccaccctgccaacgcacgtaaatcagaattgccatcccgacatcaaacgcttggaaacaaaatgccgtctgaaaatcaaacggcaacataacaatgtccctaacaaatgcaaaaatgccgtctgaaagctcttcagacggcattggcgcgccgggtttaccgcctcctgccgaaaccgcgcatagcggggcggcggtaattggcgggcgggcgcgttgtcgggcggtaacgctgcgcctgcgccgcctgttgttttgcacggaggctgcgcgtgttcaaatccctgctggtgcgcgcattggggcgtgcggactgatggtaggctgcacgcgcgcgccgggcgacgggactgtcttggttgcctgcccgtgtgaatttgtttgccagcgcgttgccgataaacgcgcctgccgccgcgccgaccaggctttgcagcagccagcttcctgtcgattggtcgtaaatatactgctgcccgtctttaccggtaacgggttgcccgttgttgccgtttgcctgtgcttcggcaggaatggtgtctttgactgcttcgggagtcagttggtaaaccgtatcgtctgcctgctgtgcgagctgctgttgcagggcttcaatctgtttctgctgctgttcgagccgcgcctgcgtgtcgtcttggcaggcggcgagtgcgaatgttgcgataagcgcggaggcgatgatttttttcatgtgtgtcctgtttgggtggaaaatcggttttattgtatcgccgtcgggaattttggcaagcattctgccggcaaatcgtgatgtttacaggggcagggtgtgcaatttgcggacaaatgcgaggctgttggcgactgggttgcctttgttttcgacttcgtgttcggtttctacggtcagcaggcggcggtttttgtgtttgttcaggctcaattcggcttgtgcgggtgtgaaaaacaggcggtgtttttcggcaaagcggcgggcgcggctgttggcggttttcaaaatctgaagcagcgatacgtccagatggaagcgtcgcacgcccaatacgagaatccgtgcggcaaaaaaatcggcggcatcggtaaactcggcggggctgctgcggctgaagtcgtgccgttcggcggctatcagggcggcaacggtgcggatttgcggaatcatcgattcgctgataagtgtgtcgtcccgccctgcatcgagaagcatgggggaaaaatcctgtgcatcatcgacaataatgctacaagtgtgcagggtttcgttttgtgcggcggtttggggcattgcattcatggtcattttcctgattctgtcgtgtgttgccgaatcgggcgacctgtgtgaaggtaacaaaaaagccgccccgttttcgagcggcctgttttgcgtatgggatggatttcaagcaagcgcaaaaaagtaccgcacgtctgtgtggtaccaatagcaataagcggttgtaaattttttgccttgcatgatgaaatgccgtctgaagataaaaatattggggagattctaaatcaaaacgctgccgcgcctcaagcattttatcgaaatttttttgatttttcatctatccgattgaaaatatttcggtttatttttaccgctgcccgatattgtcggcaatttccctttatctgctttgaaaaacggtgcataatcccgagcaaaaccgcaatcaggagcaattatgcaaaactatctgacccccaatttcgcctttgccccgatgattcccgaacgcgcttcaggcagccgcgtttgggatacgaaagggcgtgaatatattgatttttcaggcggtatcgccgtcaatgcgctgggacactgccaccctgcccttgtcgatgctttaaacgcgcagatgcacaagctgtggcacatttccaatatctatacgacgcgtccagcgcaggaattggcgcaaaaattggttgcaaacagttttgccgacaaggtttttttctgcaactcgggctcggaagcgaatgaggcggcgttgaagctggcgaggaaatacgcccgcgaccgtttcggcggaggaaaaagcgaaatcgtcgcctgtatcaacagttttcacggacgcacgctgtttaccgtgtccgtcggcggtcagccgaaatacagcaaggattatgcacccctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaaaccgcgcgccgtctgtgcgaccggcacaatgcgttgttgattttggacgaagttcaaaccgggatggggcatacgggcaggctgtttgcctatgaacattacggcattgttcccgatattttgagttcggcaaaagccttgggctgcggctttccgatcggcgcgatgctggcgacagaaaagattgccgccgccttccaaccgggcacgcacggctcgactttcggcggcaacccgatggcgtgtgcggtcggcagccgcgcattcgacatcatcaatacgcccgaaactttaaaccatgtccgtgaacaggggcagaaacttcagacggcattgctggatttgtgcaggaaaacgggcttgttctcacaagttcgcgggatggggctgctactcggctgcgtgttggacgaagcctatcgcggacgcgcatccgaaatcaccgccgccgccttgaaacacggcgtgatgattttggttgcgggtgcggacgtattgcgtttcgcgccttcgctactgttgaacgatgaggatatggcggaaggtttgcgacgtttggaacacgcgctgacggaatttgccgcgacatcagacaatccgtaaaactcaaatgccgtctgaaggcgggaaggcttcagacggcatcagaaacaaaaaaccgcttcagaaacgtggttcaacgttccgaagcggttttgtttgccatcaggactcgaacaccaattccggttccctgccctcttcgatgactgccttaccgaccaccacttttttcaagcctttcaaatcaggcaggcggtacatcgtatcgagcaggcagcgttcgacgatggacctcaggccgcgcgcgccggttttgcgttccattgcctgacgcgcgatggaacgcaatgcgccttcttcaaactccagttcgacattttccataccgaacaacgcctgatactgcttgaccaaagcatttttcggctcggtcaaaatattaatcagcgcgtcttcgtccaattcttctaaagttgcaatcacaggcaaacgtccgattaattctggaatcagaccgaatttaatcaagtcttccggttcgacgatgccgaacagcttggtaatgtcggcattttcgtccttgctgtgaacggacgcaccgaaaccgataccgcctttttcagtacgctggcggatgactttttccaagcctgcaaacgcgccgccgcagataaacaggatgttggtggtatcgacgttgataaattcctgattcggatgcttgcggccgccttggggcggaacgctggccactgtaccttcaatcagtttcaacaaggcttgttgcacaccttcgccggatacgtcgcgggtaatcgacgggttgtcgcttttgcgtgaaattttatcgatttcgtcgatatagacaatgccgcgctgggctttttcgacatcgaaatcacatttgcccaaaagcttggtaatgatttgctcgacgtcttcgccgacataacctgcttcagtcaaagttgtggcatccgccatcacgaacggcacatccagtttgcgcgccaaagattgcgccagcagggttttacccgatccggtcgggccgataagcaggatgttggatttcgacaattcgacattagctcctgctttaggatggcgcaggcgtttgtaatggttgtacaccgacaccgccaaggctttcttggcttgttcctgaccgataacgtggtcgttgaggttggcgacgatttcggcgggcgtgggcagcttgccggattcttccggctcccctccggcactttccgaaggcgtgccgtcatttccgtcttcatgcaatatttcaatacagtttgagacgcattcgtcacagataaaggcgttttcgccctcaattaaatgtttgacgtgtgatttggattttccgcaaaaggaacaagtacggttttcgttggacatggctttctttacaatgtatgcgttacagaaaacggcacgtgccgttcgggttgccaagtataataactatatccgttcttatcaatgtattaccttaaaatcccgccgattaggctataatacgccctttcgcaaccgccccggcggcaaaaatgccgtctgaaaccaaatctgaaatctgaggatattcatgagaaaaccccaacgcggctatgcccgccaagaccgtgtcaaagaacaaattatgcgcgagcttgccgaactcgtccgtaccggactgaaagacccgcgcgccggcttcattaccgtcaacgaagtcgaagttacccgcgattacagccacgccaccgtgttctacaccattttaaaccaagacgcgcgcgaaattacggaagaagtgctggaacacgcgcgcggacacctccgcagcgaattggccaaacgcatcaagctgttcaaaacgcccgaactgcatttcaaatacgacgaatctttggaacgcggtttgaacctgtccgcccttatcgaccaagtagcggcggaaaaaccggttgaagactgacggatatgcccatgccgtccgaacatcgaaccatgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctgaacggcggttaaaaatacaggctgtgcttgaataatgtgttgatatttccgcaaaatcccgacacactcggacacccgccccgcttatcgcaactttgcgaacgcccccggaaacagcaaagacatcaaataattgattttattagaatctatttgcaaagccatttgccgttacacaagaatggcacattaaaataactgatgaggatttataacgatgaagacagacattcaaaccgaattaacccaagccctactaccacacgaaaaagtatgggcgaacgaagaaaaaaccattttagccaaaaacatcctgttggatttggtggaaaaaaccgacccgaccattatcggtttgttattgagtaatgatgagttaaaacgccatttctttgtggaagtgaatggtgtgctggtgtttaaattgcaggatttccgttttttcttggacaaacacagcgtcaataattcctacacaaaatacgccaaccgcattggtttgacggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgaaaaagacaagaaatcttttttaatcaaacccttgcttttgatgaaattgatcggctttttgacgcaaaagcattctcaaaattctctcgctataccgcagacggcaaacaagccgttggcgaaatcaaacgacattcagacggcacacccgccgaaaatctcattatcaaaggcaataatctgattgccctgcattcgcttgccaagcagtttaaaggcaaagtgaagctgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaacgaacaggcatatttgaaaattttaatggatgaagttttcggaaatgaaaatttcatctgcaattttatttgggaaaaaaagacaggtgcgtccgatgccaaacagatagcgactattacagagtttgtcttatgttactcaaagaactttaaaacagttaaattaaataaaaacacgttttcttatgatacagagagatacaaattaagtgataagtttgaacaggaaagaggcaaatattatatcgacaatttagatagagggggattgcagtatagtgacagtttgaattttgcaatccaatgtccagatggcacttttacgtatccgaatggcaggactgaatttgtcaatgatggctggatatggaaatggagtaaaaataaaattgattgggcaataacaaacggttttttggagtttagaaaatcaaagtctaaaaaatctggatggagtgtatgttataaaaactatatgttggttgataacgaaaacaagccgatagaacgttctgctccctataagaacttaatacaggatatcttaaatacacatgcgacagatgaattgaaaaaactgttcggcagcaaagtttttactactccaaaacctgagagcttattgcagtatcttattcaaattgccacatccgaatccgacatcgtcttagactaccatcttggtagtggcacaaccgccgccgttgcccacaaaatgaaccgccaatatatcggtattgaacaaatggattatattgaaacgcttgctgttgaacgcttgaaaaaagtgattgatggcgagcaaggcggtatttccaaagccgtgaattggcaaggtggtggcgagtttgtttatgccgaacttgccccatttaacgaaaccgcaaaacaacaaattttggcttgcgaagattcagacggcatcaaaacgctgtttgaaggtttatgcgaacgctatttcttgaaatacaacgtcagcgtaaatgaatttagtcaaatcattcaagagcctgaatttcaatctttgccattagacgaacaaaaacaaatggtgcttgaaatgttggatttaaatcaaatgtatgtttcattatccgaaatggatgacgaacaatttgcagattgcctgaacgatgatgataaagccttaagccgtgcattctatcaatcagtaaaaaatcaagcggagaaaaaagatggcgaataataaaacgttgtttgaagtgattgaaaatgaacgtaaagcggttaaaaaatacaagcctgaattacttgaaatgccagaatttacgtccaaaaacttaaaatatgatttttttgaatggcaaaaatctgcccttgaaaactttttgatttttgaccgcacttcaaagctagacgatttccctgatttaaaaaataagccaacgcatttgctgttcaatatggcaacaggtgctggcaaaacgatgatgatggcggcgttgattttgtattattttgaaaaaggttatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgaaaccaacaaaaccaaaaccgaaaaaaccgacagcgaaacagaaaaattgctgaataatttggaagcggctgataatccgattcgtgccatttttacggtggacagattaaccgaaggttgggacgttctgaatttgtttgatattgtgcgtttgtatgaagggcaaaacggcggcggttcaaataaaaaatcaggcaaaacggctgccgctactgtatcggaaaagcagttgattggtcgcggcgtgcgttattttccatttgcgtttgaaggtaaacagccgaataaacgcaaatttgacaacgatatgcaacacgaattgcgtattttggaagaattgttttattacacgcacgatgagcaatctcgctatattacagaactgaaaaacgagttacgaaaagacggttatttgcctgaaaaagacgatgataaggtattggcaacatttaaactcaaatctgaatttgccgataatcaggattttagagagttgttaatttgggcaaataaaaaaatccccaatcccaatgccagagccaataatgcagacagcctgaaagccaatccgcaaacgcttccattccaagttcacggcaatcaactgttgcaggaaacgcaatttacagccgatgaaaatgatgaaatagcccgacaaatcgacacacaaaataattttactcaaatcataaaaatgagtgaaatggaacggcacattttcaataaatccctgcatatcaaaggaaaaaatggtcaatctttattccattttgaccgcttgcaaagcaaactcaacatttacaatcgcaatgaattgcaaaataacttgttaaaagattgacaaattgaatttttgggattagggcaagacaaacagatcagcccagatgacaaacttgcaggctgcctaaaaatcttggaaatggttgaaaaacatttgaatgaaagtgatatgccatttatcggtacaaaagaatttacgcctaaaaaattgtgggaaatttttggcacaccaaaacaaaaatgggtcaaaaaagatgatataaaaactgccattgccacgcaaaatgattggtatgtgatggataattttgctggaacgagtttggaagaagcgttaattcaatttatttcagagcatttgggcgatttgaagtctaaatatgatgttcatttaatccgtaatgaagaagtgtttaaattgaataacttttccgatggtgaaggatttatgccggactttattttattgctgaaaaataaacaaaaatcttcttccaatggtgtggatgactttttgcattaccaaattttcattgaaccaaaaggtgagcatttggtggaaaatgattcgtggaaagacgcttttttaaaggcaattacagcggaatacgggacggataagattctgcaaaaagatacaccgcattatcgtttgatcggtttgccgttttttactgacaatcaggaaaatgaacaatttacaaagtcattccctttaggggcggcatcgcttgaaaaatagagtggtgcattgcaggcaaccccgtttgacaaaacttcctttacaaaagggcgttttgtcagatatttaatcaacacattattaaaatacagccaaattttaatgccgtccgaaccctgtgttcagacggcatcgtatttttcagtatctaaaccgtttccctgccccaatctttgcctctcaaaatcgaagcatcgacatcttgaatatcgcggtgtcccgtaaacgccatagatatatccatttctttatacaggatttccagcgcacgggttacgccttcttctccatacgcgcccaagccatacaggaacgcccgacctatcattgtacctttcgcgcccaaagcccacgccttcaaaatatcctgaccgctgcggatgccgctgtccatccaaacttcgatgtcgctgcccactgcgctgacgatgtcgggcaaggctttgatggcagacacggtatcgtcgagctgtcgaccgccgtggttggaaacaatcaatgcgtccgcgccgcttttcgctgctttttccgcgtcttcaggttccataatgcctttgataatcagcttgccgccccacaaatctttaatgcgcgccacatcgtcccagctcaggcgcgggtcgaattgttcggaagtccatgaagacagcgaagacaaatcgccgacgttcttcgcgtgtccgacgatattgcggaacgtgcggcgttccgtgttcagcattttcatacaccattcgggcttggtcgccagattgattaaattggcgatggtcggtttcggcggcgcggacaggccgtttttgatgtctttgtggcgttgccccaaaacctgcaaatcagcggtcaataccaatgccgaacatttggcatccttcgcgcgcttaatcaggttttccataaactcgcggtcgcgcatcacataaagctgaaaccaaaatggtgcggaagtgttctcggcaacgtcttcaatcgagcagatagacatcgtggacagcgtaaacggaatgccgaacttctccgccgcccgcgccgccaaaatttcaccgtcggcgtgtgccatacccgtgaaacccgtcggcgcaatcgccaccggcattttcacatcctgcccgatcattttggtttccaggcttcggccttccatattgaccaatactttttgacggaagcggatgtctttgaaatccgaagtgttttcacggtaggtagtttctgtccacgaacccgaatcgatgtaatcgtaaaacatacgcggcattttgcgcttggcaacgcggcgcaagtcttcgatgcaggtcattttgctcaaatcacgtttcatttgtcgccccctgaatacctgaataactttatatgaaatcgataatgtatatcaatattgattataaggcaaatcatttcaacatttgccgcatccgccgcagctccctactttaagcgacataaggtttaaaattcaaaaataacaaattaaaatcaaaatattaaaaatcaatcaatctatcgatttaaacagccaatcacacaatccgccctcatacttgactgaaacactcagatattggacaattccacccactaataaaaaaaccgacatgggcaaccaccaccatgagactgaccaccaaagggcgtttcgccgttaccgctatgctggatttggcgatgaacgcgcaaaccggcgccgtcaaactcagtgccatcagcgaacgccaaaacatatccctctcctatctcgagcaattgttcggcaaactccgccgcgccggacttgttgaaagcctgcgcgggcccggcggcggctacatcctcgccgcaccggcggcacgcatcaacatcgcccaaatcatcgccgccgccgaagaccggctggacgcaacccaatgcggcagcaaagccaactgccaccacggcgcgccctgcctgacgcacgatctttgggagaatttaaacaaaaccatcaacgactacctcggcagcgttaccctgcaaagcatcatcgaacagaaaaacaacggcgacggcagccgcgtcgtccaatttacacacatccattaaataacacccgaaaaagaaagagcaaaccatgaccgtcaaaacccccgtttacctcgactacgccgccaccccccccgttgacaaacgcgttgccgaaaaaatgattccctatctgaccgaaaccttcggcaacccagcctccaacagccacagcttcggctgggaagcagaagaagctgtagaaaaagcacgtgcagacattgccgccctgattaacgccgactctaaagaaatcgttttcaccagcggcgcaaccgagtccaacaacctcgctatcaaaggcgcggcgcacttctacaaatctaaaggtaatcacctcatcactgtaaaaaccgaacacaaagccgtactcgacaccatgcgcgaactcgaacgccaaggttacgaagtaacttatctggacgtacaagaaaacggtttggttgatttagacgtactgaaagccgccatccgcgaagacaccatcctcgtttccgtaatgtgggtaaacaacgaaatcggcgtggttcaagatattcctgccatcggcgaaatctgccgcgaacgcaaaatcattttccacgttgacgcagcacaagcatgcggcaaagtgcctgttgatgttgaagccgcaaaagttgatttgctgtctatgtccggccacaaagtatacggccctaaaggcatcggcgccctgtatgtacgccgtaaaccacgcgtccgcctcgaagcccaaatgcacggcggcggtcacgaacgcggtttccgttccggcacattgccgacccatcaaatcgtcggcatgggtgaagccttccgcattgccaaagaagaattggcacaagacactgcacactacctgaaactgcgcgatattttcctcaaaggtatcgaaggcatcgaagaagtctatatcaacggcgacctcgaacatcgcgtcccgaacaacctaaacgtcagcttcaacttcgtcgaaggcgaaagcctgattatggcagtgaaagaactcgccgtatccagcggctccgcctgcacctccgcctcgctcgaacccagctacgtcctgcgcgcgctcggccgcaacgatgaactggcgcactcatccctgcgcatcaccttcggtcgcatgaccaccgaagaagaagtgcaattcgccgccgaactgattaaatccaaaatcggcaaactgcgcgaactgtcgccgctgtgggaaatgttcaaagacgggattgatttgaactcgattgaatgggcagcgcattaaagcgtaccaacatgccgtccgaacctttagacggcattccaaaaacaaagcaatcaagagaaaatatgaacgaacaagatttagatttggacaatctcgacaacctgcttgaagattttgacggcgttaccgtggaaggcggcgtcgattcggaaaacgacgacggctgcgaaggcggggcgtgcaaaatctaaacttcaggccgtctgaaaatcggcaaacaaaccacttaaaccatcaaaaaacattaaggaaaccacatcatggcatacagcgataaagtaatcgaccactatgaaaatccgcgcaacgtcggcacattcgacaagggagacgattccgtcggcaccggcatggtcggcgcgcccgcctgcggcgacgtcatgcgcctgcaaatcaaagtgaacgacgagggcatcatcgaagatgcgaaatttaaaacttacggctgcggctcggccatcgcttcgtccagcctgattaccgagtgggttaaaggcaaaagcctggatgacgcgctggcaatcaaaaacagcgaaatcgccgaggagttggaattgccgccggtaaaaatccactgctccatcttggctgaagatgcggtaaaagcggccgttgccgactaccgcaaacgtcaggaaaacagataaagcccttcagacggcatcatcccgcaatgccgtccgaaccacccgccgcttcaggtccgtccggggcggtacaacaaggaagaaatatgattacccttaccgagaatgccgcaaaacacatcaatgactatctcgccaaacgcggcaaaggcttgggcgtacgcttgggtgtgaaaaccagcggctgctcggggatggcgtacaaccttgaatttgtcgacgaagccgatggcgacgacctgattttcgaaggacacggcgcgcgcatttatatcgatccgaaaagcctggtttatctggatggcacgcaagtcgattacaccaaagaaggtttgcaggaaggtttcaaatttgaaaaccccaatgtcaaagactcctgcggctgcggcgaaagcttccacgtttaaggcataaaaacggcgggaccgtatcaaaaccgtcccgccattttttcgcttcctgcctgttgtagctgcctttgcctttccttttccgttccaccttgtgccggaacaaatcggatttcactaaggcttttaaagcattgtcgcgtattttgcctttattgtgctgcactttgccgcccatattcagtcctttcgtttaagaagcggcagattataaggcaaaaacagttttctgccaaaatcttacatttatcatcctactatgtcccaatatttcaccctcttccggattgaacccgctttcgatatcgacaccgaaaacttggaacaaacctaccgcgccttggccgcccgtttccatcccgataaattcgcttcagcttccgcctttgagcaaaagcaggcagtgatgatgtcttccaccatcaacgatgcctaccgcaccttgaaaaaccccatcgaccgcgccgcctacctgctgaaaacatcgggcatcgatgccgacgcgccggagcataccgctttcgcccccgaattccttatgcagcaaatggaatggcgcgaaacgctgatggaggcacgggcaggcaacgaccttgaatccttgaaaaatctcgacaacgaaatccgcgacgaacaagaaaaactgttctgcggtctgaaacagtcgtttgcccgacaagattacgacacagccgcacaacaagtccgccaaggcaggtttctcgacaaactccgcaacgaaatttcctcggcattataatccgcaccgtgtttcagacggcgtaaccgccgcaccgttccgcgtcaaaatatgctaaaataagcaacaattttttgccatacgaaacattgaaaccatgaccgacgcaaccatccgccacgaccacaaattcgccctcgaaaccctgccggtaagccttgaagacgaaatgcgcaaaagctatctcgactacgccatgagcgtcattgtcgggcgcgcgctgccggacgttcgcgacggtctcaagccggtacaccgccgcgtactgtacgcgatgcacgagctgaaaaacaactggaatgccgcctacaaaaaatcggcgcgcattgtcggcgacgtcatcggtaaataccacccccacggcgataccgccgtatacgacaccatcgtccgtatggcgcaaaatttcgctatgcgttatgtgctgatagacggacagggcaacttcggatcggtggacgggcttgccgccgcagccatgcgctacaccgaaatccgcatggcgaaaatttcccacgaaatgctggcagacattgaggaagaaaccgtcaatttcggcccgaactacgacggtagcgaacacgagccgcttgtactgccgacccgtttccccacactgctcgtcaacggctcgtccggcatcgccgtcggcatggcgaccaatatcccgccgcacaacctttctgataccgtcaatgcctgcctgcgcctgctcgatgcacccgacaccgaaatcgacgaactgatcgacattatccaagcccccgacttcccgaccggggcaaccatctacggcttgagcggcgtgcgcgaaggctataaaacaggccgcggccgcgtcgttatgcgcggtaagacccatatcgaacccataggcagaaacggcgaacgcgaagccatcgttatcgacgaaatcccctatcaggtcaacaaagccaagctggtcgagaaaatcggcgatttggttcgggaaaaaacactggaaggcatttccgagctccgcgacgaatccgacaaatccggtatgcgcgtcgttatcgagctgaaacgcaacgaaaatgccgaagtcgtcttaaaccaactctacaaactgactccgctgcaagacagtttcggcatcaatatggtggttttggtcgacggacaaccgcgcctgttgaacctgaaacagattctctccgaattcctgcgccaccgccgcgaagtcgttacccgacgtacgcttttccggctgaagaaggcacgccatgaagggcatattgccgaaggcaaagccgtcgcactgtccaatatcgatgaaatcatcaagctcatcaaagaatcgcccaacgcagccgaggccaaagacaaactgcttgcgcgcccttggcgcagcagcctcgttgaagaaatgctgacgcgttccggtctggatttggaaatgatgcgtccggaaggattggctgcaaacatcggcttgaaagagcaaggttattacctgagcgagattcaggcagatgctattttacgcatgagcctgcgaaacctgaccggcctcgatcaagaagaaattgtcgaaagctacaaaaacctgatgggtaaaatcatcgactttgtggatatcctctccaaacccgaacgcattacccaaatcatccgcgacgaactggaagaaatcaaaaccaactatggcgacgaacgccgcagcgaaatcaacccgttcggcggcgacattgccgatgaagacctgattccgcaacgcgaaatggtcgttaccctgacacatggcggctatatcaaaacccagccgaccaccgactatcaggcgcagcgtcgcggcgggcgcggcaaacaggcggctgccaccaaagacgaagactttatcgaaaccctgtttgttgccaacacgcatgattatttgatgtgctttaccaatttgggcaagtgtcattggattaaggtttacaaactgcccgaaggcggacgcaacagccgcggccgtccgattaacaacgtcatccagttggaagaaggcgaaaaagtcagcgcgattctggcagtacgcgagttccccgaagaccaatacgtcttcttcgccaccgcgcagggaatggtgaaaaaagtccaactttccgcctttaaaaacgtccgcgcccaaggcattaaagccatcgcgctcaaagaaggcgactacctcgtcggcgctgcgcaaacaggcggtgcggacgacatcatgctgttctccaacttaggtaaagccatccgcttcaacgaatactgggaaaaatccggcaacgacgaagcggaagatgccgacatcgaaaccgaaatttcagacggcatcgaagatgaaaccgccgacagcgaaaacgcactgccgagcggcaaacacggtgttcgcccgtccggtcgcggcagcggcggtttgcgcggtatgcgcctgcctgccgacggcaaaatcgtcagcctgattaccttcgcccctgaaaccgaagaaagcggtttgcaagttttaaccgccaccgccaacggatacggaaaacgcaccccgattgccgattacagccgcaaaaacaaaggcgggcaaggcaatattgccattaacactggcgagcgaaacggcgatttggtcgccgcaaccttggtcggcgaaaccgacgatttgatgctgattaccagcggcggcgtacttatccgcaccaaagtcgaacaaatccgcgaaaccggccgcgccgcagcaggcgtgaaactgattaacttggacgaaggcgaaaccttggtatcgctggaacgtgttgccgaagacgaatccgaactctccgacgcttctgtaatttccaatgtaaccgaaccggaagtcgagaactgaaaatcatctcccgatgccgtctgaagattcagacggcatttattttatccctcatccgtcatccagcttctcacaatatagcggattatagtcaattaaaaacaaggggctgtcctagataactagggaaattcaaattaagttagagttgcccctatgagaaaaagtcgtctaagccggtataaacaaataaactcattgaactgtttgtcgcaggtgtaactgcaagaacgacagcagagttagtaggcgttaataaaagtaccgcagcctattattttcatcgtttacgattacttatttatcaaaacagtccgcatttggaaatgtttgatggcgaagtagaagcagatgaaagttattttgctgaacgacaaaaccatatcaatggaattgagaacttttggaaccgggcaaaacgtcatttacgcaagtttgacggcattcccaaagcgcattttgagctgtatttaaaggggtacgaacggcgttttaacaacagtgagataaaagttcaaatttccattttaaaacaattagtaaaatcgagtttatcctagttatctaggacagccccaaaaacaaaatagtacaatattcaactttgaaggtctaaccatggcatactctgcggacttaagaaacaaagctttaaactatagtggattaaatttaaatcaggacaaggcgacgaagccgcagacagtacaaatagtacggcaaggcgaggcaacaccgtactggtttaaatttaatccactatattacgaacaatgcaaaaacatcagccaaaccgcagcaacgtttaacttgtcaagaaacacgctttacctgtggattcgccttaaaaaacaaacaggcagcctaaaacatcaagttaccggtctaaatgccgtcaaatcggataggcaaaaaccggctcaatatgttgggcaacacccggatgcctatctgcatgaaatcgccaaacattttgattgtacggcagccaccatttgctatgcactcaaacagatggggataacgcgcaaaaaaagaccaccacttacaaagaacaagacccggccaaagtaacgcattatttgacacagccggccgaattttccgactaccaacgtgtttatttggatgaaacaggatttgaccgctacctgttccgtccctatgcccgcagcctgaaagggcaaatagtgaaagcgcagataagtggaaaaagatatagtggattaacaaaaatcaggacaaggcgacgaagccgcagacagtacaaatagtacggaaccgattcacttggtgcttcagcaccttagagaatcgttctctttgagctaaggcgagccaacgctgtatcggtttaaatttaattcactataaaaacgacaaaaacgcaaaagccgccgacattcccgcatccaagtttcagtcaatcagataaccttggatttctttggttttcgcattgatttctctggtacggcagtcagattgtgccacgccgtattcgtcgccgtcggcgcatttggcattcaaaccgttttgtcagttgcggtactcgggcatgacggtttcggcaatatcggcgggcagtgcctgaaccgcgctgttcagagccgctttgacagttctttcttgtccgcttccctggccatttcgtcgataagggcttttttacggttgtgcagctcttccaagcgtgcttcggttttcgccgttttgcatgccagttcgctgaattttatgccgtttggcgttttaccttcagctttcgcattgttggcacagattttatccatcccgcttttccatgttttctgtgaggcttgcagcttattctgtacggtttgaggcaatcctttccagaactgctcgaactcgctgcgcgacagcttgtagcgttcttcccattcggatacgcgggcggcttcctgctcccgacccaatgcctcctgcgccgccgcttcttctgccgcttcaagttcttcgttcctttgtttcactttgtccaacggctctttaatcagtgccatagctgcggaacatatatgtttaaatttatgcaaaccatcatatcgggattgcacacgctctgcaagtttaccgacggttttcctgttcgataaaaatgccgtttgaaacggtcggcgttcagacggcatttttccgcaggttttatttgcggttggtctgcaggtagaggttgatcaggcgttcggtcgaactgtcgtgcttttgcggcccggtttcgccggtcagttcgcccaaaatggttttagccagttgtttgccgagttccacgccccactggtcgaagctgttgatgccccaaatgatgccttgtacgaaggttttgtgttcgtacatggcaatcaggctgcccatattgcgcgggttgaccttgtccatgagaatgaggttggtcgggcggttgccggagaaggttttgtgcgggaccagctcttcgatgcgcacctcatccataccctgcgctttgagttcggcgcggacttcgtcgggggttttgccgcgcataaaggcttctgcttgggcgaagacgttggcaagcaggatttcgtggtgtccgggcaggttgctgcgtttttcaagcgaggcaatcaggtcgatgggggtaatgtgcgtgccttggtgcagcagttggaaaaaggcgtgctggccgttaatgcccgtttcgccccagataatcggcgaggtttcgtgtccgactgctttgccgtccaacgtaacctgtttgccgttactttccatatcgagctgctggatgaatttgggcaggcggtgcaaatgttggtcgtaaggcgcgatgacgtggctgccgccgccgtagtagttgatataccagatgccgatgagggcgagaatgacgggcaggttgcgctcgagcggtgtgttgatgaagtgttggtccatcaggtgcgcgccgttgagcatttcaatgaagttttcttcgccgagatacagcataatcggcaatccgatggcggaccacaggctgtaccgaccgccgacccaatcccaaaattcaaacatattggcggtgtcgatgccgaattcggcgacggctttttgattggtggaaacggcggcgaagtgtttggcaacggcttcttcgtcgcccgcatgattcaaaaaccattcgcgcgcggtcagcgcgttggtcagcgtttcctgcgtggtaaatgttttggaggcgatgatgaacaacgtggtttcggggtggactttggacaatacgtcgcgcagttgcgagccgtccacgttggagacgaagtgcatattgaggcgcggatgaccgaaaggtttgagcgcggtacacatcatcagcggacccaaatccgatccgccgatgccgatgttgacaacgtcggtaatgacttggttggtatagcccagccagcttccgctgcggacttcgtgtgcaaattcgcccatacgttgcaaaacgcggttgactttgggcatcacatcttcaccgtcaaccacaatcggcgaattggtgcggttgcgaagggcgacatgcaggacggcgcggttttcggtggtattgattttttcgccgtggaacatctgccgcatccgctccggcacgcctgcttctcgggcaagctcgaacaaaagcgacatggtttcgtcgttgatgcggtttttggagtagtccagcgtcagtccgccgacttgcagccagtagcgttccgcacgctgcgggtcttgctcgaacatttcgcgcatatgcaatgttttgctgtcgtcaaagtgattccacaatttcgaccatgcgggtaagtcgtgaaggtgtttcatctatatgctcctgaatgaggttttttgttgtgggatgaaaaggctgccggaaactgccgcaagccgccgacgaccgttgttcggcatttcagacggcatttgtgggatgccgtctgaaggtcaatctttgtcgtaatcgatgtgcttgttgtgtatgctttttttgcttttctgcaattgcaggctggcagcatcgcccaagcgcagggcaagtccgatggcgagaatgtcgatgacggcaagctgcaagaggcgggaaaccatgggcgtgtagagttcggcattttcctgtgtggcaacgctcaacacgcagtcggcaagttgcgccagaggcgaatcgttgcgggtcagtgcgatgacagacgcgccgttttctttggcgatgctgaccgcatccaaaagttcgatagacgaacccgtgttggaaatggcaaccaaaacatcctgatcgctcaaaacagatgccgccatcagctgcgtgtgcgtatcgacataggcgacggtggacatgccgaaacggaaaaatttatgctgcgcgtcctgtgccacaatgccggaattgccgacaccgtaaaactcgacgcgacgggcgtgcatcagcgtggcaatggcgttttccagctccgactctttcaggaagcggcgttcgcccaacagcgaggcggcggcattgcccaacactttctcgaccacgcttgccatatcgtcgtcggcgttgagttcttcgtggacatagggcataccctcatgaccgatgctggcggacaaggcgagcttgaactcgggcagccctttataacccaagctgcggcagaatcggatgacggtcggctggctgacggacgcacgttcggcaatttcggcaacggcggcatggacgaaccatttgggttccgccaatgcacattcggcgactttgcgttccgcaccggaaaggtttgccagtgattcgctgattttgcttaacataatgatatgcccttcgataatgcagccccgctgcaaggagccgctgtggttaaacgtttctcaaatggttgtcaagagccgcagccgcaccggaaattccgggaaactcgctcaagacgacatacacgggaatcgcggcaagatatgcttcaaacctgcccttgttctcgaaacggctgcggaacggggaagttttgaaatattccaacacgcggggaataatgccgccacacaggtacacgccgccgcgcgcgcccagcgtcagggcgaggttggaagcaaccgtgccgagcatggcgcagaagatgtccaaagtctgacggcacaaaggcgacgcgccgctcaaagccttttccgtgatttcagacggcatcagtttggcgggtttggctttctgttttgcagccaaagcctcgtaaaccaagctcaagcccgcgccgctcaaaaagcgttcggcggaaacatggccgtatttgtttttggcgtactgccaaatcagcacttccatatcgtcaaacggcgggaaactggtatgcccgccctcgcccgccaaagccacccagcctgcgtggctgtgcaccaatccgctcacgcccaggccggtaccggggccgataacggctttgggggcaaattcgacaggcttttgcccgcctacctgcatcaggtctttgcttgaagtctgcgttaccgccaatgcctgcgcggtaaagtcgttcaaaaggatgagggtgtccagccccaaagtctgacgggtggtttcgatggaaaacgcccaatggtggttggtcatctgcacccagtcgcccaaaatcgggttggcgatggcaaatgccgcgtgccgtacggctgttgcaccgctttgattcagataggcacgcaccgcatcggtaaccgtatcgtagtctttacacggaagcacggcggctttttcaatgacgcgcggcgcggtttccagcgcaaagcgtgcattcgtcccgccgatatcggcgaccagtcggggatatccggcttgtttattcggcgtagaagacatggcagttcactccttgatggttcaaaacgaggttgatcggatattcgcggttttcgccttgtgcggcttggtcgaacacggcttttttctcttcgccccgtatcgccaaaaacacatgccccgtatgggcaatcgcatccaaggtcatactgacgcgctcgtgcggcgcggtaacgggcgtggtatgcaccaacgcgacacctgccgaaccgtcgattgccgtctgaaactgcggagctttcgggaaaatcgaagccgtatgcccgtcgtttcccatacccaaaaccaaaacatcgggctgtttgtaatgtttcagtgcataatcgacaacagcatcgggatgtaattcggtttcagtttttccgtcttccaccataggaatccacattgccgcttccgctttgttcttcaacaggtattcgcgcaccaaaccggtattgctgtcggcgtggacggtcggcacgatgcgttcatctgccaaggtgatgccgacgtttttccaatccaaatctttttgcgacagggcgttgaaaaatgcaatcggcgaacgtccgccggaaactgccaacaccgcaccgcccttctcgtccagtgcgccctgcaaagcatccgccactgcgtcagccaaagactgcgccgcttctgccgcattttcgtattcgtgccaaacaaacatatttgtgtcctttttttatttcagacggcatattccgttatggaaacgggttgagcaatatgtcggccgaacagttgtttatgcttttgataccaaatatcgggactgctttttatagtggattaaatttaaaccagtacagcgttgcctcgccttgccgtactatttgtactgtctgcggcttcgtcgccttgtcctgatttttgttaatccactatactactttacttatgttcagacggcatttcaaaccccatgccgtctgaacgcattattgtattactgctcttcgtgccacttgtgtccgtcgcgcgccaatagttcgcgcgcggcttcaggcccccacgagtgtgcgccgtagccgtgcggcggcgtggtgttatttgtccagttttccaaaatcggcatcacatattcccacgcggcttcaagttcgtcgcggcggttaaacaaagcgagtttgccgttaatcacatccagcagcaggcgctcgtaagcttccgcgcggcggccttccaatgctttgcccaaatcggttgccagcggcacggtttcgaccttatttcctgcccccggggttttcatctgcgtatagaggcgcacggattcatatggttgcaactcgataacgagccggttgggcgcggtgcggctgccttcaaaaatatggctgttcaaatctttgaagttcaaaacgatttccgccactttgcccgccatgcgtttgccggtacgcaggtagaagggaacgcccttccagcgttcgttttcgatttcggctttaatggcgacgtaggtttcggtaaagctgtcttgcggaacgttgatttcttcaagatagccgttcatgcctctggcggcggtatattgtccgcgcacgacgttttcattgacagactcgacggtcagcggcttcaatgacttgatgactttgactttttcatcgcgcaccgcgtcggcatccaagctggcgggggcttccatcgcagtcatgcacaacatctgcatcaaatggttttgcaccatatcgcgcaacgcgccggtaatgtcgtaaaactcaccgcgctcttccacaccgagctgttcggcgatggtcaactgcacgctttcgatatatttattgttccacagcggctcgaacattacattggcaaaacgcagcgcaagcaggttttgcaggctttctttgccaaggtagtggtcgatgcggtaaatttgcccttctttgaaataacgcgcaacatcggtattgatttgctgggaagaagccaaatccgtacccaacggtttttccaaaactacgcgcacattgtcggcattcaaaccgatcgcagcaaggttttcacaggcttgcgcgaagaatttgggcgcggtggacagatagatgacgacgttgtcggtttctttgcgcgctttgaccaaatcgcccaaagcggcaaaatcgtccggctgcgtaacatcgactttgagatatgcgaaacgttcgacaaacgatgcccaagcctcatcggaaaaattttctttcacatggattttggaactggtttccaccttcgccagaaaaccttcggtatccaactcgctgcggctgacccccaaaatacgcccttcgggatgaagcagaccggcaacatgcgcctggtacagacagggcaacagcttgcgcatcgccaaatcgccggtcgcaccgaacaacaccaaatcaaaatttgtttgtgtactcatcgtattatctcgtcaggaaagaatttttcgatgccgtctgaaacctgtttcccccatcacgctgcatcgcaatatcggaaacaaaggcaggcggcataatgagtagtaatactacacaccgctacactttttgtctattcccatttttacaatttatttgacctagtccaaaaatcgggcaggtttcccctattccgttacaacaatcgaaagattctgcgatttaaatcaaatttcttttcaatgcctgatttttttgtaacaaaattacaaattttgtactataataacacccgcttcccactttcagacggcataccttttaaaatatagtggattaacaaaaatcaggacaaggcgacgaagccgcagacagtacagataatacggaaccgattcacttggtgcttcagcaccttagagaatcgttctctttgagctaaggcgaggcaacgccgtactggtttttgttaatccactatacttaccgtctgaatacccgatacaaaaatcagaaacgcacaaacaaatccccaataccccccccgttccgacaggagaccgaccgtgaacactactcctatccactccaaactcgccgaaatcaccgggcgcattattgaacgcagccgtccgacgcgtgaaaaatatctggcgaagatccgcagtgccaaacaaatgggacgcttagagcgcaaccagctcggctgcagcaacttggcacacggctatgctgccatgcctaaaagtatcaaaatcgaaatgcttcaggaaaccgtccccaacttaggcatcatcaccgcctacaacgacatggtttccgcacaccagccgtttaaagacttccctgaccaaatcaaagacgaagcgcagaaaaacggcgcgaccgcccaagtcgccggcggcacgcccgccatgtgcgacggcatcacgcaaggctacgccggcatggaattgtcgctgttctcccgcgacgtgattgccatgagtaccgccatcgggctgtcgcatcaaatgtttgacggcagcctgtttatgggcgtatgcgacaaaatcgttccaggtttgatgataggcgcgctttcgttcggtcatattccgggtatcttcgtccccgcaggcccgatgtccagcggtatcggcaacaaagaaaaagcccgcacccgccagcttttcgccgaaggcaaggtcggacgcaacgaacttttgaaaagcgaaatgggttcttaccacagcccgggcacctgcactttctacggcacggcaaactccaaccaaatgatgatggaaatgatgggcgtgcacctgcctgccgccgccttcgtccacccttacaccgacctgcgcgaagcgctgacccgctacgccgccggacacctcgcgcgcggcatcaaaaacggcacgattaaacctttgggcgaaatgttgaccgaaaaatcctttatcaacgccttgattggcctgatggcaaccggcggttcgaccaaccacaccatgcacctcgtcgctatggcgcgtgcggccggcgtgattttgaactgggacgacttcgacgaaatttcctccatcatcccgctgctcatccgcgtttatccgaacggcaaggccgacgtgaatcactttaccgcagcgggcggactgcctttcgttatccgcgaattgctgaatgcaggcctgttgcacgacgatgtcgataccgtcgtcggacacggtatgcgccactacaccaaagagcctttccttatcgacggcaaactcgaatggcgcgaagcccccgaaaccagcggcaacgacgacatcctgcgcaaagctgacaacccgttctcccccgacggcggtctgcgcctgatgaaaggcaacatcggacgcggcgtgattaaagtgtccgccgtgcgcgaaggctgccgcattattgaagcgcctgccatcgtgttcaacgaccaacgcgaagtgttggctgcgtttgaacgcggcgagttggaacgcgattttgtgtgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtccggcaaagttccagcctccatccacatgacacccgaagccctgatgggcggcaacatcgccaaaatccgtaccggcgacctgatccgcttcgactccgttagcggcgaactcaacgtcctgattaacgaaaccgaatggaatgcccgcgaagtcgaaagcatcgacttgggcgcgaaccaacaaggctgcggccgcgaactcttcgccaacttccgcagcatgaccagcagcgcggaaaccggtgccatgagtttcggcggcgaatttgcctgatgcgcgtttcagacggccttttcagaccgaaggccgtctgaaaaattattcaagcgttttaagatagacgtaggttggattctcgaatccgacacagccgtccaagatgtcggtttcttgaatccgacctacaacctgtcccatcttaataaaataccccattccacccggagaaccgaaatgtccaaactgaccccccgcgaaattttgaccgccggcgcagttgtgccggtaatggcgattgacgacttaagcaccgccatcgatttgtcccacgcccttgtcgaaggcggcatccctaccctcgaaatcaccctgcgcacccctgtcggcctcgatgccatccgcctgattgccaaagaagtgcccaacgccatcgtcggcgcaggtacggtaaccaatcccgaacagctcaaagccgtcgaagacgcaggcgcggttttcgccatcagcccggggctgcatgaatccctcgccaaagccggccacaacagcggcatccccctgattcccggtgttgccaccccgggcgaaatccaactggctttggaacacggcatcgacaccctcaaactcttccccgccgaagtcgtcggcggcaaagccatgctcaaagccctgtacggcccttacgccgatgttcgcttctgcccgacaggcggcatcagcctcgccaccgcgcccgagtacttggcactgcccaacgtcctgtgcgtcggcggctcttggctgacaccgaaagaagccgtgaaaaacaaagactgggacaccatcacccgcctcgccaaagaagcggcggcgttgaaacccaaagcctgattcgcatcgtaaaaatgccgtctgaaaaacctttcccgtttcagacggcattttgccgattgagggcacagtcggcatacacggcagcactgatcagacataccgcccctaaaatgcccatccgccttccgcataataaaaataacgttcagttcattcgacagcagccggacagcccatactacgcggctgaaaaaatgccgtctgaaacgcattcagacggcatccacttaaaaaaaacaactgattcaacgccgattaatccgcttccaaaaccactttcatcacttggttttcggcggcgtgtttgaacacgtcgtaggctttttccaattcactgaatttgaaatgatgggtcagcattttggtgtaatcgacggagctgctggaaatcgccttcatcagcatttcggtggtattggcgtttaccagaccggtagtgatggcaagctttttaatccagagtttttccagtttgaaatcaacggattgaccatgtacaccaaccacagcgatatggccgccgggtttcacaatgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataaggcgtacggacgtattcggcctgagtaccgtcaatcatgtaacccaaaatccaaccgccgttacggcagtgtgaatagagttgggttttgcagttgtcgcaagtgcaacatttgctgacgcatgaaataatgactttatcgccgactttgatgttttttacagcctcgccgacttcttctacaataccgatgccctcatgaccgagaatacggccgtcggcaacttcggggtttttgcctttccaaatacccaaatcggtaccgcaaatcgtggttttgacgattttcaccaccgcatcggtcggatcgataatctgcggacggggtttttcttcaaaacggatgtcgtttgcgccgtgataaaccattgctttcatgctgatactccttgcttgttgataaataatttcaataccgcaataaagtttctttatatgagttatatgcccctacaaaaaataagtcaataagaattattttcacaatgttatacaataacataccgttttaaatataaataaaaccaccgattgatattaatgaacacacccatccccttctccgarcggctcatccgctggcaaaaacaacacggtcgccaccacctcccttggcaggtcaaaaacccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgcgtactctgccgcgtgttcgcccgcgacggcaatccgcaggacaaaaaatttgaaaactcgctctggacacttgccgaaagcctgctgccgtctgaaaacgccgatatgcctgcctatacacaaggtttgatggatttgggcgcgaccgtgtgcaaacggacgaaacccttgtgccaccaatgcccgatggcggacatctgcgaagcgaaaaagcaaaaccgcaccgccgagctgccgcgcaaaaaaaccgccgccgaagtaccgaccctgccgctttactggctgattgtccgcaaccgggacggcgcgattttgctggaaaaacgccccgccaaaggcatttggggcgggctgtattgcgtgccgtgttttgaaagtttgaacgggctttccgactttgccgccaaattctccctgaccatggcagatatggacgaacaaaccgccctgacccaccgcctgacgcaccggctgctattgattacgccctttgaagcacaaatgccgtctgaaagcccttcagacggcatttggataaagccggcgcatttgaaagattacggtttgcccaagcctttggaaatttatttaaacggtaataggttagaataaacaaaataaacccattgaactgttgtttgcaggtatcgcagcaagaacaaccgatgaatttgggtcgtattttaggcggcgggataatgttcaaatgggacatttggaacggaagaagtcggcaatttaaaaaggatttaaaaagcaaagaaggtcaaaaacatgaacacaaacttaaatgacaaagacaaagccatggataccgcaatcaggtttcagaaaaggatgaggattccgaaatttttctttttaattctcggaatcacaatggttttggcatttatccaagacgtgataacgggttctaattttctgcaaataacaattaatgtaaaattttcgtaaaaatttatcggcttttaaaacaaaattgactaaaatagtcgcgagtttttactgcaataaaggagattgcaatgaatatgaaaaccttattagcactagcggttagtgcagtatgttcagttggtgttgcgcaagcacacgagcataatacgatacctaaaggtgcttctattgaagtgaaagtgcaacaacttgatccagtaaacggtaacaaagatgtgggtacagtgactattactgaatctaactatggtcttgtgtttacccctgatttacaaggattaagcgaaggcttacatggtttccacatccatgaaaacccaagctgtgagccaaaagaaaaagaaggtaaattgacagctggtttaggcgcaggcggtcactgggatcctaaaggtgcaaaacaacatggttacccatggcaagatgatgcacacttaggtgatttacctgcattaactgtattgcatgatggcacagcaacaaatcctgttttagcaccacgtcttaaacatttagatgatgttcgcggtcactctattatgatccacacgggtggtgataatcactccgatcatccagctccacttggcggtggcggcccacgtatggcatgtggcgtgattaaataattcgattgttcgaaacgaaaagtgcggtgaattttgaccgcacttttttgctagatatttagcattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtttcaattcataagtttcccgaaattccaacataaccgaaacctgacaataaccgtagcaactgaaccgtcattcccgcgaaagcgggaatctagaccttagaacaacagcaatattcaaagattatctgaaagtccgagattctagattcccgctttcgcgggaatgacgaaaagagacctttgcaaaattccttttccccgacagccgaaaccccaacacaggttttcggctgttttcgccccaaataccgcctaattctacccaaatatccccttaatcctccccggatacccgataatcaggcatccgtgctgccttttaggcggcagcgggcgcacttagcctgttggcggctttcaacaggttcaaacacatcgccttcaggtggctttgcgcactcactttaaccagtccgaaataggctgcccgggcgtagcggaatttacggtgcagcgtaccgaagctctgttcaaccacataacgggtcttcgacaaatatcggttgcgtttggtttgcacttccgtcagcggacggttgcggtgggctttgcgcataatgccgtccagcaactgatgttcttccagatgttgccggttttccgcactgtcgtagcctttgtcggcatagacggtcgtacctttgggcagtccttccaacaacggcgacaggtgtttgcactcatgggcattggcgggggtaatgtgcagtttctcgatatagccttctgcatcggtacgggtatgttgtttgtaaccgagtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaaaagcagcctacacgcccatcccccgccttctacccgttctgtaaatcatacagatagcggtaatatccgttcggcttcgccagcaattcctgctgtgttcccgcttccacaatcctgcctttatccatggcaatgatccggtgtgccgttttaacagtggacagacggtgggcgataatcagcaccgtccggttggcgcaaatggcctgcatgttctgcataatcgctcgttcactttcataatccagcgcgctggtggcttcatcaaaaatcagaatgcgcggattggtgattaacgcgcgggcaatcgcaatacgctgccgctgtccgcccgacaagccggccccttgttcgcccaccacggtgccgtagccttccggcagctccataataaactcgtgtgcgcccgccagtttggctgcttcgataatgcgttccagcggcatacccgtatccgtcagcgcgatattgtcgcgtatgctgcggttgagcagcacattctcctgcaagaccacgccgacctgccgccgcagccaggcaggagcggccaaagccaaatcgttgccgtccaccaacacccgtccctgctccggtacatacagacgctgcaccaatttggtgagtgtggatttgcccgaccccgaacgtcccacaatccccagcacttcccccgcccgaatccgcaggttcaaatcctgcaaaatcagcctgccgtccgccttatagcggaaatcgacatgttcgaacgtaatctccccccggatatcgggcaaagccaaatgcgaagacgcattctcggtcggcgcattcagaatatcccccaaacgcgccaccgaaatccccacctgctggaaatcctgccacaactgcgccaaacggataacaggcgccgccacctgtcccgagagcatattaaacgcaatcagctgccccaccgtcagcttgctctcaattaccagccgtgcgccaatccacaacgtcgccaccgtcaccagcttctgaatcagctgcaccccctgctggccgaccaccgccaacttcgttacccgaaatcccgaagccacataagccgccaactgattgtcccaacgctgcgtcatctgcggctccaccgccatcgcctttaccgtacccaccgcagtgatgctttctactaaaaacgactggttgtctgcattgcgcgcgaacttatcgttcagacgcgtccgcagtatcggactgataaatgccgaccaaaacgcataggcaggcaacgaagccaataccacccaagtcagagtggagctgtaataccacatcaccgccagaaagataaacgaaaacgccaaatccaacaccgaagtcagcgcctgaccggtcaagaaattgcgaatctgctccaattcccgcacccgagccaccgtatcacccactcgtctgtgctcgaaataggataaaggcagggaaagcagatgccggaacaaacgcgcgcccaattccacatcaatacgtgaagtcgtatgtgcaaacagatacgtccgcaaaccgcccaacacaatctcaaacagcgacaccaccaacaaagccaccgacaccacatccaaagtagagaatccccgatgtaccagcaccttgtccatcaccacttggaaaaacagaggcgtaatcagcgcaaacagctgcaacaccaccgacaccaccaatacttcaaaaaacaaccggcggtatttgattaccgccggaataaaccaggtaaagtcaaactttgccaaactgcccaataccgaagcgcgggaagcaaccaatatcagtttgcccgaatatctgttagaaaattcggcaaaagacaataccgcagacttattcgtaaccaaatcctgtatcaaaaattgggcatgctcaccctcaccgtctgttttggccaaaatgaaatggttgccgtcatcacaccataccaatgcgggtaaagtcgccatagccaaacgtttaataggctggcggactacctttgccttcaatcccaaagatttggcggctaacagccattgcgtttcatttaaatcgctctgtgcggaagtacaaaattcatgctgtatatcggcaggattggcggcaatgccgtggtaatgggcgaggatgatgagggcggaaagggcggggagcggtgcggatacgatagacataaataaaatatagttagattggatgtggataacggctggctggaaaaggaatatattaagtagaaagaaatatataaataaaacagcagaacgcattgtaaggatatatatgggaattgtaaagagaaagtatggaaaagttctcgtttcaggaaggtaaaacggcttaggaatcgagttagatgaggatgcctcgcacctctcgtgcctcctgcataccgttaaggcacagggttaaggtgcaggctgctccgaactctgttgcggtcgggtaatgttattttttgtgtttcaggcagcctgaaatatctgtatatttttgttttaaatagattttaaagattgataactgttcttgacgatttttcaagaaaggagtaaatttcaagaaaggagtaaagtgacttattatcaatgacaagcaacgcgcgaagtgacaaggaaaactatctacttaaattctaaggaggcttcgaatatcataaaccaatcagaaacatagagataaaaattatgtacaaatataatcctcttatacaatttattgcacagttgattatgtcttatggagcaagcgtagggtgggcacttgctgccccacgcgtttcatatttcaaggcagcctgaaaccgtgtgggcataaatgcctaccctacatcccaaaaaacaagcgcagcctgcgtgtgtagggtgcgaactttcggcaggtagacacgcagttttatattttcaagctgagggatgcttaagaaaagtacaaaacattaaaaaataaggggctgtactagattagccctaaatccacaccaatcccgcaagatttttagctgtcgggacggtgtgccgaagttaaatcgaaattcgcattctttcaagaacagcgggaaagatttgcgatcaattccgttctatttgcgcaagacgcgttttgcctgattccaaaagttctcaatgccgtttatgtggttctgacggtcagcaaattccttggaatggttgatgcggtaatggataaaaccgcttacgtccaacttgtcgtaactgctcaggctgtcggtataaacaatgctgtccggcatgattttctgtttgataacaggcattaaagtatcggacttggcattatctacgacaacggtatagacccgtccgttacgtttcagaatgccgaagacaaccacttttcctgccgcaccgcgaccacgtttgcctttacgccgtccgccgaaatagctttcgtccaactcgacagagccctcgaaaacctcattggcagccaaggccagataatggctgatgaccatacggattttgcggtagaacaggactgccgaattgggatggatacccaaaatatcggcagcagaacgggcggtaacttcgagtacaaaaaaacggagcagctctttctgtacttttttctttaatttgcagtgtgttatcttcatatttcgggggtaacatatctgctaatctagtacagcctcaaacaaaaaagagaaattttaatttcgctaaatcgcataaagattaatcaagagtatcattaaatgatatgagtgagcatctataatgccaagaagagttgttaagacataacgattattgaaatagattgtaaaatagatacttagatagtctgaaaaacggatttgtgaaactttttattacgcgccatcatttgaaaatgaaacttaaaaaacacttatcataataaatattttctttacgttgtttgctaataaactcagtgcaatatcagcgcaatattttatggaaattttatggataacaaaaaagaatttattaataatttaacaaataggtatatgtggatctatccattggtcttaaatattctatttctacctttttaccagtcctaccaatctttttttattgcgcttggttgtttgtttgcactggttagaaaaatgcaaagcttagattttaaattacaaaatcatattgtattgttaaatataaaaagtgcttgggcagataaaaaagtatttttgattaggatagtagtgtcatggttggcagtaatggaaatatggatgtgttttatttcggaatcatcaacgtgggtatgcggtgctttttgtttaaatagtgaaatattggaaaaaatttttcgtggctttggttattctggtagtttatattttttatttatattgatgattgatctcaataagttaagagagagtatttgaatttcattttttgtttgacttaaactcaaggagagtaacaatgattggtagtggtgatactaaacaatgcaaaaaattttctgcgtgtgatggaaaataccacgtctacgatcccctcgccctagacttggacggcgacggcatagaaacagtcaccgccaaaggcttttcaggcagcctgaagactgagagagtgaatacgatgagtatacactctatgccactaaattgatattcactaaatcataccagctatattttatttaatgagacatatgaaaaataaaaattatttactagtatttatagttttacatatagccttgatagtaattaatatagtgtttggttattttgtttttctatttgatttttttgcgtttttgttttttgcaaacgtctttcttgctgtaaatttattatttttagaaaaaaacataaaaaacaaattattgtttttattgccgatttctattattatatggatggtaattcatattagtatgataaatataaaattttataaatttgagcatcaaataaaggaacaaaatatatcctcgattactggggtgataaaaccacatgatagttataattatgtttatgactcaaatggatatgctaaattaaaagataatcatagatatggtagggtaattagagaaacaccttatattgatgtagttgcatctgatgttaaaaataaatccataagattaagcttggtttgtggtattcattcatatgctccatgtgccaattttataaaatttgcaaaaaaacctgttaaaatttatttttataatcaacctcaaggagattttatagataatgtaatatttgaaattaatgatggaaacaaaagtttgtacttgttagataagtataaaacattttttcttattgaaaacagtgtttgtatcgtattaattattttatatttaaaatttaatttgcttttatataggacttacttcaatgagttggaatagttttggtaattttatgagcgcacgctcatccgcgttagcagaatttggaaatatggttgctaatttagtttctgcaaaaaatgagaaagatatctcgaaacgtaatgaatattacaaacaagctggttatagtgcattattagcatttggtaatttggctagtaatattgcaccaggtagtacgtcatcgcatattgtaaacggaacaaatgcctctgtgattgcaagccgtctctctggaaatatatcttcagctattcaggagcataaagatggtaaagttaatatcaaccgttttcaaaatattttagcggatttatattcattgggagggttaggaagtacattaatagagaagaatggaaatatgcagagttgggggattccattagcaattgctggagatataattgcagcaacggctattgccacaggagatactggtacgatatctacagaggaattttataattttgacaactggaaaggttttgggtatgagctatttgaagactggtctcgttgggtatacgactggctgcccgacggctggaatctgtggaaagaattggacagaaaccgttcaggccaataccacatctacgaccccctcgccctagacctagacggcgacggcatagaaacagtcgccgccaaaggcttttcaggcagcctcttcgaccataacggcaacggcatccgcaccgccactggctgggtttctgccgatgacggtttactcgtccgcgatttgaacggcaacggcatcatcgacaacggcgcggaactcttcggcgacaacaccaaactggcagacggttcttttgccaaacacggctatgcagctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcacgaacaaaatgctatccattagccatgttcgggaaaacacgatttccccgtttgttttaggctgtctaaacaaataaccataaatgtatatcattatttaaaataaataaaagtatttaactattattgacgaaattttagagaaagagtagactgtcgattaaatgacaaacaatagtgagaaaggaaatatttactatccgagcacagagcatattttaggtagcctgtaactgttcctgctggcggaagaggatgaaggttgacttacccgagaataaatgtcctgttgtgtgatatggatgccatgccgcgaagcaattgatgcaatcacggcagtcctacttgaatgaaacctgtcgttgcagaatttgaaaacgctatttttaagaaaggataaagggagaaagaatttttggtttttaagctgcatgaaaccgtgttggaataaatgcacacctacgataattaataattttcgttttttattctacaagctatttatatatgattgctaaaagtttattttttagatgccaaaaaatatattttatatacttcatattgtttatatgtctttatttgaatatatcttacgatggggaaatatttatatattttataataaattttactcatttgctaatatgtcatggaatattacttgtattttgtagaatttttccatatgaaaatattccatttactatttttctgaactttattagtttatttttaatatttttacctcttatatttaccataagagagctaattgattcatattatattgagtcgataattaatttattcttaattttaattcctcacgttatttttttaatttacttgaaaggaaagcagatatgacatctgcaaattttaatattaacggttttggagatgtgaaattaacaccctattcaccactcttgggatataaagcttgggattcatttattggttctattcaatccttatctgatttaatctataatgtggataacaatagaaataaaatggaaattactgttaataatgctattcaagctgcagatagctttttaagcagtaattggaagagataacaaaataacaaaataacaaaataacaaatactgcttctttacttgcatccttcgataacattttttaaatttaagaaatgtatctcgagatatacgagaaacaggaaaatttaaacctaatgatattcaacaagcaattggtgatatattcattgctgctggtgatggattacaatatataaaacaacaaacagaggcgatggctcaaagcaaattcttaccaactaaattaaaaactggtttaaatgatgtccttaattctagaatgctaaaatcctctactgttttacagcatgaattgaattaaataaggattatggaaacgagaggcttggcgaatctataatgaatatagatgattttacaccaagtaagatagcaaacttttttgcggatcctgatacatacagcaatgtattagaagaagtatctaggtttatatattccttagttcctgatgatgcaaacccttggaaagggggcgaagattatattggacgagggataagtgaatggggagagttactggaaaaatggtataaacaagattttctcccttatcttgaaaagaatgggaccaatttccgaaatttgaagattggctgcctgaattccctgaatgggcaagagagtggttgaaattagctctcaaacgttcaggcaaatataacgtttacgatcccctcgccctagatttggacggcgacggtatagaaaccgttgccaccaaaggcttttcaggcagcttatttgatcacaccaacaacggcatccgcaccgccacgggctggattgctgcatatgacggttttcctgtgcgcaaattaaacagtaacgggggcattattagcacgacagataccatattccaatctttgcatacatggcttgatcatcaaccaagatgatatttcccaagcacagcatgatgcatgccattgaaaaatatagaaaattaattgaaagcttaaatggatattgaaatgaatgatcacatagtacaaattataagaaggttcgggctaggtaggatatttttttattcgtatagcaaatcatctataataattttttcttcgtatgttgtttattatataatttacaattatcaatttaattacctttcgcttttaatttatttattaccaatattgtgcagtatatatatgtttatattttttttagggaaaactaaggatacattaacgacagagcgaagaaaaaaattttttaattctatttttccacttagaattctaatgataataggttctgagaaaaagaggttaggcatcggtagtttttatttgctaaacctactatggattatttggtgtcttatgattcatagagaacaagtcccattaaataacttaaccctcctattatccttcatattttcattattttttttattatgtgattttgttttattattgaatgtttatgtttatttttttaaattaagagaggcttaatatggttaatcaaatcaaatctgataataattcagtttctattgaatttatataagattttataactgcaagtacggatgtaattaatctgagttacgaaaattttcgtaaaaatttttatacacaaatgtcaactgattctaccaattatgcagccaaacatgaaagtttaggaaaatcggtacaacgtgaattacaaaaaacacaaagtcagttgagacaagttgtaagaaaaatgcagagtaaatataatataaataataaagcacgagtagcagaaatatctttgttaaggcaaatgcaaagccaattttctcgaaaatatgtaaacaaaaatcttggtaacagcaacactttggctcaacaaggcagctacaccaaaaaagacggcacaaccgcgcaagcaggcgatttgctgttggctgctgacaacctgcacagccgcctcacggacaaaatgctatccattagccatgttcgggaaaacacgatttccccgtttgttttaggctgtctaaaacaaataaccataaatgcatatcattatttaaaataaataaaagtatttaactatttttgacaaaattttagaaatagagctagagttttagttaagtagaaattgatagtgcttcaagggaagtattctctatgtttgcattaaagggggtctgataaagctattattcattactatggacttttatttcattattttcaggcggaaatctcatagccgttttgaatttttctcttccttattaattatacaaataattagtatattctgatatggattttttggaaatttttattatgtctgcatttagaaaaatattattaataatatcttgcctattgattgctagctgcagttttgttgaaactattttttatatggctattagcccagaacctgttgtggtagactttcctcttggtaaaaaaacaaaaagatctattgaactcaaacagaaaattggtaaaccttatgcaatatcgttaggaactaattttatacattatgatccaaaacagggggagaggtggattgatgataagttaaactatccatataatatatcggttaaaatatttaaagtggaagaagatggtaaaaaacttattatagatgagttgcttacagagagaagtagaaaattaggaggcggagtatttggagctgggggaaaatacagtatgcatatttatgatttttatttgccggaaggggaatatttatttgagatttctgataatagtgaatatattccactttacgatgaaataaataattctataagaatagtagttaatgcacgaattcagtaaatttttctagaaatgtggggttacttatggctgattattatgcgataactgtaaaatttgcgaagcagggtacgccactgaaacaagagggggtgtatccaagacgggtacgtttgggttgaactgtattcggctagagataaaaaaatcggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaaattctcaatgccgttaatgtggttctgacggtctgcaaattccttggaatggttgatgcggtaatggataaaaccgctcacgtccaacttgtcgcagctgctcagactatcggtataaacaatactgtccggcatgattttctttttgatgacagggagtaacgtttcagacttggcattatctacgacaacggtatagccccgtccgttgcgtttcagaatgccgaagacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtactgccgaattgggatggatacccaaaatatcggcggcagaacgggcggtaacttccagcacaaaaaaacggagcagttctttctgtacttttttctttaatttgcagtgcgttatcttcatatttcgagggtaacatatctgctaatctagtacagccccaaaaatataccaaaaacagcaaaacaaattgtaaggataggtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcatcggaactatcataggtatggagagaacgattacagcactagcgtaggttcctgtattaacggtttcacggtacggtattacccgtttattcgggaaaagcagcagctcacacagcaggagttggtaggttatcaccaacaagtagagcaattggtacagagttttgtaaacaatccaagtaaaaaataatggggctgtcctagataactaggataaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctggttccaaaagttctcaattccattaatatggttttgtcgttcagcaaaatgtgtgctgtgattgatacgaaaacgaagtttcagcgaagctaaaatggctaaattcgcgcacatctaatacatcatagctacgataacaatccgtataaataatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaatagctcaatgagtttattttgtttatactggcttagacgactttttctcatagggataattctaacttaatttgaatttccctagttatctaggacagcccctattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcactgcaacatttcaggcaatatgcgcgtctaattaatcaaaataatggtagattacccaatactagtgaaattgagagaagttactataaagccgttaccgataatggcgtttcttccagtgcagctattgatttagttattaatcgttcacttccggatatggcggatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgatgatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaaggaaatgaagcttttaaaaatgaaatcaatagcttggttcatgatatgaaagctgctggcaaggaatttggagatgacttaaatacacagtggaataatctcactcaggctgccgaaataatctataatgacatagtagacaatactagtcaaggaatagaaaaaggtgtcaaagccattaaagaattgtctgaaaaaatgaaaaatgctgcttccgatttggctgacggttcagcagagaaagctaaacaagtagtggaagatttggctcaagccgccaaagaagcatacgaaaatgccaaatccacagccgagaaggctgctcaagcagctcgagaattttttaagggcttgcccagttttaaagatctggccgaaaaatttagagatctgttcccaaatccggaaggctggatcgatgatggtcaccaatgtttagctccttgggttaaagaaactaaaaaacgcaatggcaaatatcatgtctacgacccccttgccctagacctagatggcgacggtatagaaaccgttgccaccaaaggctttgcaggcagcttatttgatcacaccaacaacggtatccgcaccgccaccggttgggtttctgccgatgacggtttactcgtccgcgatttgaacggcaacggcatcatcgacaacggtgcggaactcttcggcgacaacaccaaactggcagacggttcttttgccaaacacggctacgcggctttggccgaattggattcaaacggcgacaacatcatcaacgcggcagacgccgcattccaaaccctgcgtgtatggcaggatctcaatcaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgccggtaatgattacttggagggcggcagcggttcggatacttatgtcttcggcaaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtactatttccagaacgatggctcaggagcttaccgtatcgacgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcaatggaggagaaggcaacgacgccctgtacggctataatggtaacgatgcactgaatggtggcgaaggcaatgatcatttgaacggcgaagatggcaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaagtaccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaatcacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggctttgtcgccttgtcctgatttttgttaatccactataattaatatgactttgcggccgttttgccattgcgtaataaaacgatggggaagtgatgataaaacgtgtgtgtaactatatcagacggcattgtttttctgtttgacggcctcaatccaaaattttgccgacgatttcgcccacgtctttcgacaatccttcctgcgcccgaatgcgctgcaatgcttgtttcaccaagtttttgcggtgcggctcgagcttgttgcagaggttgaacgcctgcactaagcgggcggcgacctgcgggttgaagcggtcgatttcgatgactttgtcggcgatgaagcggtagccgctgccgtcttctgcgtggaaatgcgggacgttgcggctgaagctgccgatgagcgaacgggctttgttggggttttcgaggctgaatttcggatgctgcaaggcggttcgaacctgttgcagggtgtcgctgcggcggcttgagccgacgagggcaaaatatttgtccatcaccagcgcgtcgtctgaaaacttgtcggcaaactgcgccagcaggcggttgcgcgtatcgctttcgttgccgttgacggcggacaggatgccccattcgtgggtcatgttttgcgccatttcgccgtatttttcggcaacggtttcgatgtgcgcggggtcggcgcgcaggacaaaggcgcggcagacgttgcgcagcgtgcgccagccggcggcttcggggctgtattcgtagctttggttttcctgcttcgccgcctgacggttcaattcgtgccatttcggcaggaagtggacggcaagcgtatccaacaaggcttcgcgcgcctgatggtagcgcagcgggtcgatgttttctgcgccgtcccacagctcggcttcggatggcacgcccaaaagcagggctttgaaggcgttgtctaagaggtcgtctgaaatgactttttcgacggcggcaagcagtttttcgtgtttcggcagctcaacgccgtctgaaagcgtggcaaggttggcggcgacggcgcggcggtagagcgtttgggcggcttcccagcgcgtgaaggcgtcgctgtcatgggcgagcaggagcagcaggtcgtcgtcgctgtacggatagttcagatgcaccggcgcgctgaacccgcgcagcagcgagggaacgacggcttcggttacgccttcgagcaggaaggtctgttcggcttcggtcagcagcaacacggcttcggtcgcgcgtttgccctgatagtcgaatgccaccgcttcgccgttgcggttcagcagcccgaccttgacgggaatcatcatcggctgtttatccgtcatatcgggcgtgggcggcacggtttgtttgacggtcaactcgaaaatattgtttttcagacgaccttccgcttccaaaacgggcgtgcccgcctggctgtaccacaaggcgaactggtcgagattgatgccgttcgcgtccgccatcgccgcgcggaaatcgtcgcaggtaacggcctgtccgtcgtggcgttggaaatagagcttcatgcctttctggaagccctcttcgccgagcagggtgtgatacatccgcactacttccgcgcctttttcataaacggtcatggtgtagaaattgttcatctcctcatagctggcggggcgcaccggatgggcggtcgggcctgcgtcttcggggaactggtgctggcgcagcaggcggatgttttcgatgcggcgcacggcgcggctggcgcggtcgccggaaaattcttggtcgcggaacacggtcagcccttccttcagcgaaagctggaaccagtcgcggcaggttacgcggttgcccgtccagttgtggaaatactcgtgtccgaccacggattcgatgccttcgaaatcggtatcggtggcggtgcggctgtcggcaaggacgaacttggtgttaaagatgttcaaacccttgttttccatcgcgcccatattgaaatcgcccacggcgacgaccatgaaaatatccaagtcgtattccaaaccgaagcgcgtttcgtcccatttcatcgcgtttttcaacgattccacggcaaagccgaccttgggcttgtccgcttcggtggtgtaaaactcgattttgacgtttctgccgctcatggtggtgaaatagtcttccgttaccgccaaatcgcccgcgaccaaagcaaacagatagctcggtttggaaaacgggtcttcccatttcacccaatggcggccgtctgaaaactcgccgccgtcgattttgttgccgttggaaagcaaaacgggatagcgttttttgtcggcgacgatggtggtggtgaacttggacatcacatccggacggtcgatgtaaaatgtgattttgcggaagccctccggctcgcactgggtaaacaaattgccgccggaagcatacagccccatcagcgatttgttttccgccggcaggatttcggtttccacttcgacggtgaagcgttcggacggcacgcccgcaatcgtcagcgtctctccttccaacacataatccgccgccgccccgttgattttgacggacaagagtttcgccgaaccgtccaacaccagcggctcccctaccctctgcggctcaaccgtcaaacgcgacttcacgacggtttgcggttcattaatatcaaaatgtaaatcggttttgagaatatggtaggcgggcgtttgatagtctttgagataatgcacggttttgctcatttttttctttcaatgttattttgtttgactggaaaaggcttcagacggcacgggcgcatcccgcgtatgccgtctgaagccgcagcggcggcacgggcgcgccgccggacaaccggtttgaattcaatctttattcccacgcgcggacaaactcttcccaatgcggcttttccccggcttgtgcggacaggtaattccgcatccgtttgatttccatttcgtattcgtccgcatccagcctgccgctgaccagacagaaacgcaggtacatcagataagtgtttgccgcgtcggtttcgcaataattgcggatttccttcagcctgcccgtatggaatgcctcccaaaccttgctgccgtccatacccagcttgcccggaaaaccgcacagtttcgccatatcgtccagcggcacgtttgccctcggctggtaaagcgcgagcaaatccatcaaatcgcagtggcgttggtgataacggctgatgtagttgttccacttgaaatcgcggctgtcgccgaaatcgccgtcgcccatatcccaatagcgcgcggcgttgatgccgtatatcagggagcggtaatgcagtacgggcagatcgaaaccgccgccgttccaactgaccagttgcggcgtatgtttttcaatcaattcgaaaaatttagcaatgaccacttcctcgccgtcatccatctcgccgatggtgccgacatgtactttatcctgcccccaacgcatgcagcacgaaatcgccacaacctgatgaagatgatgctgcataaaatcgccgcccgtctgagcacggcgtttttgctgggcaaacagcaccacttcatcgtcgggcagcgaggacggcagctcgtacaatgttcggataccctgcacatcgggtacggtttcaatatcgaaagccaaaatcgtggtcatgacagcaccttgtatttaaaacggatgcacctattgtgtcattaaaaggcggataaaaaaagaggcaaccccccacaggattgccccaatacctcaaatcagagatttacgcttcacaaacaatacaggctttcgcctgcggctttacccgcgtagctcaactctacgccggcaaactttcgtttcaccgtttccgatgaaaccccgaccaatcgcaagactgaccggaaaatcctttcagacggcatttcctgcctgtcgtgtaattccatgtagcgaaatgtacgccattttctacgctttgccaagcattttttacaatataaatgtcaaaacattaattttataaaattgctgaaaatattaaatatatggatttttattttttatatttcaataaatataaatttaattttgatttatatttaaatttaagcataaaatgtcaaatattaaagtaaacatgaaaggcatatattaaatatttatttataacgctatgtttttaaagaaaattaattttaatatattaactagattgtctgcatatattcataggtttgcggtatttcttccaaaacctgcttcgaatttcccgaccaagtcttaaaaatattgtttttgagatacttaaatagcagcgattatcaaatgaaatctgttcatataatctgccattttgcatttaaaaaaacaatcaggagtttcgactcgaaacgcctgatatgttttgtaattttacgtagtcagtaaaaatcggggctgccttccggacgggttttaaaacgcttgtgcagccaaaaatattgttccggatgttcgcgcaccctgtcttcgataaaacggttcatgcgctgcgcgtcggctttcgcgtcttcacccggaaaggatttccaagcagggtagaaatgcaatgtaaccgtattgtctgcctcgcggacgggaatggcgggtatcacttttgcatttgcaagcgcggcaatgcggctcaatccggtaatcgttgccgtctgaataccgaaaaaatccacaaaaaccgaatcgttgcgtccgaaatcctgatcgggcagatacagaaacggcgcgctgcttttgcggaactgtttgacgagggcgcgcagcccttcggtgcgcccgataaggaagacgttgtgatagcggttgcggcctttcaaaatctgttcgtccaatatcttgtttttttgatgggaatacatactgatcagcgggatatcctgattaagcgcgtacaccgccatctcgaacgcggtgaagtgcggatacaggatgatgactttttcccccgccgccagcgcgtcgtccaaataatgcttattgcggtagcgcaccagcgatttcaaacgtccggcaggcgcgtaccaatataaaccgtattccaacatcagtttcgccatgtgtttgaaatgctgtttcaacacggttttacgcttttcctcactccattcggaaaaacattttgccaaattgatttcgccgatacggcggcgcggtttgaccagaaggtaggcaagcaaacccgtcaggtcggcaatcttgtgcagcagcgcaaacggcagaaactgcaaaacatacagtacaaaaaatataaatttcatctcgatacacattttcttttcagacggcaaaatacaaatgccgtctgaaactattgaaacctgccgcgcttgacctgcatccccgaaggattgagtttggcggcaagcccgtggttgcgtaaggcgtgggtcagcgcgacggcaagaccgtccgccgcatccggctggggcgttcccgaaagtcccaacatctgcaccaccatatgctgcacctgttcttttgccgccttgcccttgccgactaccgcctgtttgacctgcaaggccgtgtattccgaaacgggcagcttatggctgaccaatgccgccaatgccgcgcccctagcctgaccgagcatcagcgtcgatgccggattgacgttgacgaacacctgttccactgccgcctgttgaggcttgtaaacggtaacgacttcgccgatgtgccggacgatgacggcaatcctgtctgccagaggcgcatcggcaggcgttttgatgcagccggaggcgacgtaaaaatgatcccgccccctgacatcgatgacaccgaaacccgttacgcgactgcccgggtcgatgcctaagatacggacgcttgcagccatattcacaacaaaccgtgttgaatcagcttcttacgcagggtattgcggttcagccccagcatcacggatgctttggactggttgccgccgcattgctccatcacgcacaccagcagcggtttttccacctgatgcaataccatatcgtacacgccgcaaggttcggtaccgttcaggtctttgaaatattgttctaaattttgtctgatgcattgggaaatatcgggaagggtatggggcatgattgcactttcaaaggataatcaagtgttcagaaggcatttgggcggtaggcgcacgcccaactgtcggttttttcggcaagtctttcaagataacctgcaagcatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgtatggcgcggatgtggttcaaaatagcggcggcgcattctgccaaactcaaggcaggcggcaaaacaccgtgttcggcataatgtttcaaatcgcggaagaaccacggcctgccttgcgcgccgcgccctatcataatgccgtcggcggcggtttgtttgaggacggcttgggctttttgcggcgaagtaatgtcgccgttgacccagaccgggatgttcagacggcatttggtttcggcgatgagttcgtaacgcgcttcgcctttgtacatttgcgtacgcgtgcgtccgtggacggcaagggcggcgatgccgcaatcttcggcgattttggcgatgacgggcaggttttgatggtcgtcgtgccaacccaaacgggttttgagggtaacgggtacgcctgccgcacggacgacggcttccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaagcaggatttccaatctccggacgcgcccgcgattgggtcggacaccgttttatggcataatccgcacacagattccctgccccgccactcacaggcgggcagtttatagtggattaacaaaaaccagtacggcgttgcctcgccttagctcaaagagaacgattctctaaggtgctgaagcaccaagtgaatcggttccgtactatctgtactgtctgcggctcgccgccttgtcctgatttttgttaatccactatatttccccgtcctatcggtttcccgtttcagacgacataaggtctgaaagaaagactacaattatgagtaatccattttcctctttaggtttgggtacggaactcgtttccgcactgaccgcgcaaggttacgaaaacccgacgcccatccaagccgccgccattcccaaagcactcgccggtcatgatttgctagccgccgcgcaaaccggcacaggcaaaaccgccgcctttatgctgcccagtctggaacgcctcaaacgttacgccaccgccagcacctcgcccgcgatgcaccccgtgcgtatgctcgtcctcacccccacgcgcgaacttgccgaccaaatcgaccaaaacgtgcagggctacatcaaaaacctgccgctgcgccacaccgtcttgttcggcggtatgaatatggacaaacagaccgccgacctgcgtgccggctgcgaaatcgtcgtcgccaccgtcggacggctgctcgaccacgtgaaacagaaaaacatccatttgaacaaagtcgaaatcgtcgttttggacgaagccgaccgtatgctggatatgggttttatcgacgacatccgcaaaatcatgcagatgctgccccgccaacgccaaaccctgctcttttccgccaccttctccgccccgatacgcaaactggcgcaagacttcatgaacgcgcccgaaaccgtcgaagtcgccgcgcaaaacaccaccaacgccaacgtcgagcagcacatcatcgccgtcgataccattcagaagcgcaacctgctcgaacggctgattgtcgatttgcatatgaaccaggtcatcgtgttctgcaaaaccaaacaaagcgtcgaccgcgtaacgcgcgaactggtgcgccgcaacctgtccgcacaggcgatacacggcgaccgttcccaacaaagccggctcgaaacactcaacgccttcaaagacggcaacctgcgcgtcctcgtcgccaccgacatcgccgcgcgcgggctggacattgccgaactgcccttcgtcatcaattacgaaatgcccgcccagcccgaagactacgtccaccgcatcgggcgcacggggcgcgcgggcgcggacggcgtggcgatttccctgatggacgaatccgaacagaaaatgtttgaatccattaaagagctgaccggcaacaagctgctcatcgagcgcatcgagggcttcgagccgcaatggtgggaacagggcggcgcaaaaccggaaaaacccgaaatgcgcgaaccgagacaacgcaaccgctacgaatccgccaaagcgcaacgcgaaaaaaacacccggccggaaaatgcggcaaacgatgcgggcgcggcttgcggaaaaattgccggacgcagccgccgaagccgccgggaacaccggacgtgcgccctgctccaaccgcgttacggcgtaaaatagccctgaaaatcaaatgccgtctgaacatttcccgtttcagacggcatttttcaaaccggactgacgcatcgggagcaaccgcccgcaccggataaatttctgccgcaaacagtttcagacggcatttgccgcctgtacaatatagtggattaacaaaaattaggacaaggcggcgagccgcagacagtacaaatagtacggaaccgattcacttggtgcttcagcaccttagagaatcgttctctttgagctaaggcgaggcaacgccgtactggtttaaatttaatccattaatagtgtatattaagtacgtctgatatacacgataccctacgagggtgtaagctttagttcacatttaaaatgacctctttaaacctgtctttcggcaggtttctttttaggttgtttggaaatcgtgtgcagacaaggtgtaaaataggtaacagcataaaataatgcggttttaccgcccatatatttacaaaagccaaatttttaaacatatatccttgatatatacacggcgtaaacatatactggaaacatctttaaattttccgaaattttaaatatgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacctcattccaatccctcgttaaagcatagccaaaataatcaataatccggaggtcaatatggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcatagtccttaacgatgtccaaggcgatacgaccatcaacaaccatcatacgcatacgcacaaccacagcgatgccgatggcaaagcactgtcgatgaggctcacaccccgtcctttgttgtcagaccgtcaggcggcggctttcgcccgtacaggcaaactcacgggcagtttcgacctgtttgcttcggtggtcgccccctcgcagtacacgtttgccgttgccatgcccgacacgtccatgtcgccggttatcgaaaagggagacttgctggtggtcgagccgcgtatgtgccctgcggacgaagacatcgcgctgattgaactgtccgacaagcggctggtcgtcgcgcaccttgttatcgatattgcgggcaggatgctgatttatcagacgggcaggccgtctgaagcctttgacctgcccgaaggcagcacgattttaggtgtggtgctggagtcaaaaaacggtttatgtccgccgcacaggcaagaaggcgtgttgattcggattaccgcccctgatgtgtggacggttggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgactgccttgtccgaatgggtcggtcagttggaaaccgaataaatccgtaccgccatacaaaatgccgtctgaatccaatcgggttcagacggcattgccatttcaactgtttttatgattactcggggcgcatctgcggaaacagaatcacatcgcggatggtttgcgaatcggtcagcagcattaccaagcggtcgataccgatgccgcaaccgccggtcggcggcaaaccgaattccatcgcgcggatgtagtcggcatcgtagtgcatggcttcgtcgtcgcccgcgtctttttgcaccacttgcgctttgaagcgttcggcttggtcttcggggtcgttcaactcggaatagccgtttgccagttcgcggccgacaacgaacaattcgaaacgttcggtcagaccttgtttggtatccgaagcgcgcgccaacggtgaaacttcgaccgggtaatcgacgatgaaggtcggattccacagcttgccctcggcgcaaccttcaaacagcgcgagttgcaggctgccgatgcccggggacggcggcaggctttcgccgtgtttgacgatttcttttttcagccattccgcatcgttcaactgctcgtcggtgtagtgcggattgtattttttgatggcttcgagaatggtcaggcgttcaaacgggctttccaaatcgacttctttgccgttgtaagtgatgtttgccgtgccgtttaccgtgcgcgatgcgttgcggatgatgtcttccgccatctgcatcatgcgttcgtagtcggagaaggcttcgtagaattcgatcatggtgaattcggggttgtggcgcacggacatgccttcgttgcggaagctgcggttgatttcaaacacgcgttccaaaccaccgacaaccaggcgtttcaaatacagctcaggcgcgatacgcaggtaaagcggaatatctaaggcattgtgatgggtaacgaagggttttgccgtcgcgccgccgggaatcgggtgcatcatcggggtttcgacttcgagataatgctcgcccaccataaaattacgcacggattggatgatttggctgcgtttgataaaggtattgcgcgattcttcattggcaatcaaatcaacatagcgttggcggtatttggtttcctgatcgctcaaacctttgtgtttgtcgggcagcgggcgtagggatttggacagcaggcggatgccggacacgcgtacggtcagttcgccgtggttggttttgaacaaagtgccttccgcgccgacgatgtcgcccaaatcccaatggttgaagtcgtccaaaacttcttggctcacgcctttgttgttcagataaagctggatttgcccggacacgtcttgaatggtggcaaaactcgccttgcccatttgacgcttcagcatcatgcggccggccactttgacgggaatgccttgcggatcgagttcttctttgccgatttcgccgtattgggcgtgcaaatcggcggcgaagctgtcgcgtttgaagtcgttgggataggcgttgcgctgttggcggatgttgtgcagtttttcgcggcgcagggcgatgatttggttttcgtccaactgcggctcggtttgcggatggttttgttcgctcataaggttttccgaaaaaataaatcaggcgcaatctgtttcagacgacctgaccgaatcacaaaatttgcgcatattttacgcgatgtcggcatttttttccataaacgcgacaatgccgtctgaaagcggtttgcggtttcagacggcatcgttatcatttgaacattcccgccaaattcaataagaacaaaacggtaaaaccggtcagataaatcaagcctgccaatgcaagggcattcatacctgatgtgagtttgtgtttttcatcacctttaaccaaacggtaattcagccaggcaaacacaggggcggacacaaaagcggcaatcatcgcaaatttgagcagattcgccattacgccgtcaaaccagaaaatcaccgccaaaccgctgcccgccacccaaatattccaggcaaagaattcggcgttgcccgttttgtcttttccgcgcagcaggcgcacgggttcggcaatggcacgggcatagccgtccacgacggtaatcgtcgtgccgtacatacaggcaaacgcgataaacgccaccagcgggcgcgaccagccgccgatggtaacggcgtacatattgatcaattgcccgatatatttgccgcccgccatctgcactgcttcgccgttgccgtattgcacaaacgcgcccagtgcaaggaaaaccaaagccaaaaccgcactggcgatataaccgacgttgaaatcaaaaatcccgtcgcggtattcggaaggattgatgcgttgtttttcggttacccacaaagaattgatggcggaaatttcaatcggcgcgggcatccagcccatcagcgcgatcaggaagcccaaaccggcaagcgtccacggtgtcggctcgataaaatcggactgcatctgcataccgcgcgacatagcgatgccggcggcggcaagcgtggcgatactcaaagtaacgatgatgattttggaaacgcgatccaaagcgcggtaacgtccgctcaccaaaataatcaggcaggatgccataatcaaggcggcaaccgtgccggcatcaaacatcagcgagggaatcgccattttgacgatggcggcggttacaatggcgaccgcgcccgcgttaatcgtggcggagaggatgcacaaaatcaggaatacccacaaataaacgcggcttttctcggcataaccttcaatcaggctcttgcccgtgtccagcgtgtaatgcgcgctgaagcggaaaaacgggtatttgaagaggttggtcaggatgatgatgagcgcgatctgccagccgtaaagcgcgcccgcctgcgtcgaggcaatcaggtgcgaaccgccgaccgccgccgaagccatcatgatccccggacccaatgcgttgattttacttttccaagtcgaaatatgttgttcggacataaagtcttccgtatttttaactgtgtttcaacacacagagccgcatattcggacacagccctatctattgctccaatttgggcgggattgcccccaaacaaacccaaatcctaccgtcttcaaaaacaggataccgcccggtagggaaattttgatgaaaacacgtattgtaacgtaatccaaatacctgccaacacacactattagaacttcatgctcaaacttgactatattttccatattacttccaaaaaaaggcataaaacgacattttatgcctaaaattttacaacaaacaaccttacatcgcttttttcgcgcaaacacgcaccatccgatcagcccgtccgttttgcagcaggctggcgatttgataagatggttatgtttttcagacggcatttcagatttccgtccatgccatctgaagccgcaaaacccgattggaggaactgttatgaataccgtatcgaattatctgtccgcattacgcgaagccatgaaggcgcaaggcttggatgcactcgtcatcccttccgccgacccccacctgtccgaatacctgcccgagcattggcaggcgcgccgcgaattatcgggctttaccggctcggtcggcacgtttgtcctgaccaccgatgaagcgggcgtgtgggtggacagccgctattgggaacaagccgccaaacagcttgcgggcagcggcattgtgctgcaaaaaagcgggcaagtgccgccgtacaacgaatggctcgcggcaagcctgcccgaaaacgccgccgtcggcatcccttccgatatggtctcgctcaccggcaaacgcactttggcgcaatcactcgccgccaaaaacatccgcatcgaacacccggataatttactgaatcaagtgtggacaaaccgccccgccctccccgccgaaacggtgttcatccacgaccccgactatgtttctgaaaccgccgccgaaaaactcgcccgcgtgcgcgccgtgatggcggaaaaaggcgcggattaccacttggtttcctcgcttgacgacatcgcctggctgaccaacctgcgcggcagcgacgtgcctttcaatcccgttttcgtgtccttcctgctgattggcaaagacaacgccgtcctgtttaccgaccgatgccgtctgaacgccgaagccgccgccgcgctgcaaaccgccggcatcgcggtcgaaccttacgcccaagttgccgacaaactcgcgcaaatcggcggcgtgctgctcatcgagccgaacaaaaccgccgtcagcacgcttgtgcgcctgcccgaaagcgtgcgccttatcgagggaatcaacccatccacgctgttcaaatcctgcaaatccgaagccgacatcgcccgcatccgcgaagcgatggaacacgacggcgcggcgttgtgcggtttcttcgccgagtttgaagacatcatcggcaacggcggcagcctgaccgaaatcgacgtggacaccatgctttatcgccaccgcagcgtgcgcccaggcttcatttcattgagtttcgacaccatcgcaggcttcaacgccaacggcgcactgccgcattacagcgcgacacccgaaagccacagcaccatcagcggcaacgggcttttgctcatcgactccggcgcgcaatacaaaggcggcacgaccgacatcacccgcgtcgtccccgtcggcacgccgagtgccgaacaaaaaagcgacaacaccctcgttctcaaagcccatatcgcgcttgccgaagccgtgttccccgaaaacatcccctcgccgctgattgatgcgatttgccgcaaacccctgtggcaggcgcaatgcgactacggccacggcaccggacacggcgtaggctatttcctcaacgtccacgaaggcccgcagcgcatcgccttcgccgcccccgccacgcccgaaaccgccatgaaaaaaggcatggttacctccatcgaacccggactctaccgcccgggaaaatggggcatccgcattgaaaaccttgccgccaaccaagccgtcgccgcccctcaagaaaccgaattcggcagcttcctctgttttgaaaccctgaccctctgccccatcgacacccgcctgatggacaccgccctcatgaccgacggcgaaatcgactgggtcaaccgctaccacgccgaagtccgccgccgcctcgagccgctgaccgaaggcgcggcaaaagcgtggctgatcaaacgcaccgaaccgctggcgcgttaaacagcacggcgcaaaaaatgccgtctgaaagcccttcagacggcattggtttcccaaaacatcccgcaccgttttcatcttgccgcaagcaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccgctatattccgccatctctaagatttacagcgatacacgggtgatttaaggaatgcccgaaccgtcattcccgccacttttcgtcattcccacgaaagtgggaatctagaaataaaaagcagcaggaatttatcggaaataactgaaaccgaacagactagattcccgcctgcgtgggaatgacaattcgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcactatatgtgcaaaccaagccaaaaatgcgaaataccgtctgaaaatctttcagacggtatttgctgtctttattgccgtttttcttccgtatccggatttttgtttggggctgaagcagattggcagtcagattgcaatcaaagaatgaaggcgagccgtcaaaaacaaagctatccgcttcaccgccccgatatttagaatttgtggcgcaaaccgacggaggcggcattaatttgagtgtagttgccgatgccggtattgcgtttcagccaagcgccagacacgatggcggaagtgcgtttggaaaaatcataatcaacgccggcgatgatttgatcgtagctggtattttcgccttttttaccgcgttcgataaagtcgaaaccatgggcatagctgatgcgtggaactgcattaccgaagcggtaggaagcagtggcggcaatttcggtcgtactgtttttggttttgtcgccattttcagacaaatccaactgagccgccaaggcgagattcaagccgccttcctcatagccgcccgtcagacggtgtacctgatggtttttcaagggatcggtacctttggcttgatcactcccgctgccgatcaagaacaactcaaaagcattacgtccgacattggcgtgtctcgcatatttaaaggcatagttcccggcaaaaccgccatttttgtaattcagaccggcataatacacatccgatccgggcttgccgacaacagccggaacgagagtaagattattgtttgtattcttagtataataagccggcgtataggcggacttgctgttttggatcggaacgaattgaacgctgccgctgaaaccggaaaattcgggggaatcgtagcgtacggaaaccggcatgtcgtcgtggcgtttgaaaatacccaattgcgaagccacatcattattgctgtcccaaggatcaatggcttggctggcatcgtcaaactgattcgcaacgcgaccggcgcgcagcgtaccgaattcgcctgccaagccgataaaggattccctgttgccccactgggtcgcgccgccgccggcaacggatacgtcttgctcaagctgccaaacagccttcagcccgtcgcccaaatcctcactccccttaaagccgataaacgagccgaaatcactgattttcgtcctgatgcggcttttggccttagtaactttagtaacttttacctgaccgctcgctccaccgttagcggcttgtgcttcagtcaattgcagctggtagttcctgccttccacgccggctttgatttcgccgtataggctgacatcggcaacggccgcaagcggcagtgcggacaatacgagggcggtaagtttttttcgcatatcggcttccttttgtaaatttgataaaaacctaaaaacatcgggcaaacacccgatacgtcttcaattatacccccccccccgcaaaaaaccatttttcagaacaaatatctgataaatgccgcaacctttattttaaaaatgattatattttgatataaaacaatagcttattttttcaaaaacgttgtgtttctacaacacaattcaagcgcagacctcgtgcgagccgatgcgctgctgcccggatgcagtctcggctttttaaaacgccataaaaaaacacacgcggcactttatagtggattaacaaaaacaagtacggcgttgcctcgccttagctcaaagagaacgattctctaaggtgctgaagcaccaagtgaatcggttccgtactatctgtactgtctgcggcttcgtcgccttgtcctgatttttgttaatccgctataaagaccatcgggcatctacagccgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaatgaccgaaactgaacggactggattcccgcctgcgcgggaatgacgggattttaggtttctgattttggttttctgtttttgagggaatgacgggatgtaggttcttaggaatgacgtggtgcaggtttccgtacggatggattcgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaacgaccgaaactgaacggactggattcccgcctgcgcgggaatgacgggattttaggtttctgattttggttttctgtttttgaggaatgacgggatgtaggttttcttaaccctgcgtcctagattcccactttcgtggtaatgacgggatgtgggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctggaatttcaatgcctcaagaatttatcggaaaaaaccaaaacccttccgccgtcattcccacgaaagtgggaatctagaaatgaaaagcaacaggaatttatcggaaatgaccgaaactgaacggactggattcccgcttttgcgggaatgacgggattttaggtttctgattttggttttctgtttttgagggaatgacgggatgtaggttttcttaaccctgcgtcctagattcccgcttttgcgggaatgacgggatgtgggttcgtgggaatgacgtggtgcaggtttccgtgcggatggattcgtcattcccgcgcaggcgggaatccagaccttagaacaacagcaatattcaaagattatctgaaagtccgagattctggattcccgctttcgcgggaatgacgaaaagtggtgggaatgacggttcagttgctacggttactgtcaggtttcggttatgttggaatttcgggaaacttatgaatcgtcattcccgcgcagacgggaatctggaatttcaatgcctcaagaatttatcggaaaaaaccaaaacccttccgccgtcattcccacgaaagtgggaatctagaaatgaaaagcagcaggaatttatcggaaatgaccgaaattgaacggactggattcccgcctgcgcgggaatgacgaattttaggtttctgattttggttttctgtttttgagggaatgacgggatgcaggttttcttaaccctgcgtcctagattcccgcttttgcgggaatgacggcgacagggttgctgttatagcggatgaacaaaaaccagtacggggttgtctcgccttagctcaaagagaacgattctctaaggtgctgaagcaccaagtgaatcggtttcgtactatctgtactgtcttcggcttcgtcgccttgtcctgatttttattaatccactataatttcctgcgtgtgtcgggtgtatcgaaatcaagccgaatcaaatatatcggacttcgataatgtcgtattcgcgcacgccgcccggggcttggacttccgccgtatccccctcttccttgccgattaaggcgcgggcgatgggtgagccgacatagattttgccctgtttgatgtcggcttcgtcttcgccgacaatttgatagataacgtgttcttccgtttccaaatcttccagcgtaaccgtcgtaccgaacacgattttgccttcggcgtggatttcggtcggattgatgatgtgggcaacggaaagtttgtgttccagctcggaaatgcggccctcgataaagccttggcgttctttggcggcttcgtattcggcgttttcggacaaatcgccgtgcgaacgggcttcggcaatcgcttcgatcacttcgggacgcgccacgcttttgagctgctgcaattcctgtttcagcaattccgcaccgcgtacggtcagggggattttttgcatcggtcttttttctccatattccggcacaccggtttgcggcagcaagcataccgcgtaccgtcttgttttgtgcgtccggatattaaaataaaaatacaagccgcccggaaaatcggcggcttgtctgtcgttgaacagcggctattctaccaaattctatgaaattggcaatcgtgccgcgccgccggcaaacgcgccatgtccgcaacaaaagctgaaaatatgccgacaaagaaattttagaaacaaaaaatttaaaaataatcaattttcggcataaaaaaccacatttacggactttaaaaccgaaaatgccaagcctgagatttttcatacagcatttgcaccagtataatgcaggctgtttttatctttaataatattgacgttttgccatgaccgaatccgtccgcctccccgtcgcccgtctcaaaccttccaccgtcgccctgcccggctccaaaagcatcagcaaccgcaccctgctgcttgccgccttgtccgacaatgcttgcgaaatccattccctgctcaaatccgacgataccgaccgtatgctcgaagcactcgataaactcggcgttcaaatcgaatatcttgccgaagaccgtctgaaagtgcacggcacaggcggacgcttccccaaccgcactgccgatttgtttttgggcaacgcgggcacggcgttccgcccgttaaccgccgctctggccgttttgggcggcgattatcatctgcacggcgtgcctcgtatgcacgaacgtcctatcggcgatttggtcgatgcgttgcggattgccggggccgatgtcgaatatctcggcaaggaacactatccgccgcttcatatcggcgaacgccaagacaacggcgagcgcgtgattccgattaaaggcaatgtgtccagccagtttctgaccgcccttttaatggcgttgccgctgaccgggcaggcgtttgaaatccgtatggtcggcgaattgatttccaagccctatatcgacattactttaaaactgatggcgcaattcggcgtacaggttatcaatgaaggctaccgcgtcttcaaaattcccgccgatgcgcactaccacgcgcccgaacacttgcacgtcgaaggcgatgcctccagcgcgtcctacttcctcgcagccggtttgattgccgccacgcccgtccgcgttaccggtatcggcgcaaacagcatacagggcgatgtcgcctttgcccgcgagctggaaaaaatcggggcggacgtggtttggggcgaaaacttcgtcgaagtttcacgcccgaaggaacgtgccgtccaatcctttgatttggatgcgaaccatatccccgatgccgccatgaccctcgccatcgtcgcgcttgctacagggcaaacctgcacgctgcgcaacatcggttcgtggcgcgtcaaagaaaccgaccgcatcgccgcaatggcaaacgagttgcgcaaactcggggcaaaagtcgtcgaagaagccgaagcaattcacatcaccccgcccgaaacgctgacacccgacgccgtcatcgacacgtacgacgaccaccgcatggcgatgtgtttctcgctggtttcgctgttgggcgtacccgtcgtcatcaacgatccgaaatgcacccacaaaaccttcccgacttatttcgacgtgttctcatcgctgaccgaaacagcggaataaggcggcattttgccgcgattccggcgcggcgcggcgggcggctcattctgtaaaaaaagtatgtgcgccgaggtagtttttggcgtaaaacggtgtggagagtttttcggttttgatggttttgccgctgctgggggcatggatgaattcgccgttgccgatgtagagtccgacgtgtgagtagcggtgtgcgccgccggtgttgaagaatacgaggtcgccggccttgaggcggctgtcggggattttgcggcttgccgccgccatgtcgcgggcggtgcgcggcagcttgacgttgagggcgtttttgtaaacgaattgaatcatgccgctgcaatcgaagccggttgcggtgctgctgccgccccatttgtagggcgtgccgatgagtccgaggctgtggagcatgagttcctgcgagccttgtgtgcggtcgatgtggctgatgcggacggcttggatttgccggactgtctgtttgggtttcggttggcggtgtttgccggaggtcgtgccgcatgaggcgaggagcagtgcgctgagacagaggaaaagggttttgtcggggggaaacatggtttttcctttgcgggttcggatatccgtctgaaggtgtttcagacggtatagtggattaacaaaaatcaggacaaggcgacgaagccgcagacagtacaaacagtacgaaaccgattcacttggtgcttcagcaccttagagaatcgttctctttgagctaaggcgaggcaacgtcgtactggtttttgttaatccgctatatttctataataaaccttctatgggcagcagggataggatttttgcggcgatgcgtttccaaagtttggcttcgggttcgttcgggtaggtttttcgggtggcgggatcgtgccattgcaggcggttgtgcctgtcgagggtaacgcggtaggcgtaggcgggtgtggtatcggcaagggtgcgctccatctgttctgcgattttggggctttcgataacaacgcccatttcggtgttgagacgcgcggaacgggggtcgaggttgaacgaaccgatgaagatgcgtttgccgtccacaatgaaggttttggcgtgcaggctggttacggagctgccggtcaggcctttgtcttttgtggcggggacggcatggttgggttgcagctcgtagagtttgatgccggctttgagcagcggttttcggtatttgacatagccggaatggacggcggcaacgtcggtcgcctgcagcgagttggtcagaacggtaacgtctatgccgtcctgcaccagttttgccagtgcgtctgtgccggattttgtgggaacgaaatagggtgaaaccagatagacgcttttttcgggctgtttgagcgcgtcttgcagccgcccggcaatcggcggtttgcggcggtcgcggtcgagtccttttgcagggtcgtcgctgatgaggcgggttcggacgctctgccagtcgatgcatcctgtctgtattttttggtagaggggcgactgttcgacggtttcgcggtagcgcaggagcgcgtgtctggacgtttcgtcgttgtatccgagtgcttgaagacccttgccgatgtcgccgctgcggatgatgcgcgtggcgttgtgggcggaatggcttgcccagtagcggtcgaagtcgtgcgatacttcgccgacgacgctgccggtggcgaggatgtccaaatcggcgaaaacggtgtcctcaccgactttgaagtattcgtcgccgatattgcgtccgccgagtatggtggcgcggttgtcggcggtaaaggatttgttgtgcatgcggcggttgaggcgggggaagtcggtcaggtagccgagtgcgcgccattttcgtaagacgaaggggttgaacaggcgcacttcgatattgggatggctgtcgagggcaagcaggaggtcgtccaatccgcgcgtgttgttgtcgtccaacagcaggcgtacgcgcacaccgcgttctgcggcaaggtacacgaggttgaacagcagcctgccggaaatgtcgttgcgccagatgtagtattgcaaatcgaggctgtgttcggcagattcgataagggcggcgcgggcggcaaaggcttcgtgggggtcgttcaacagatagatatcggatagcccgttggtatgaggggtgtgccggatttgcaggatgttgtccaggcggacgggtttggaagtattgaaatgacggctttccgtccgttcttccagtgggggcaaccatgaagaacatgaacagagaaggaggcataaaagggaaattaggctgcgtgttttcatcagggatatggtttcagacggcattgcctgtgttttggggttggcgcgcatggaagtgcggtatcataatccaaacgttgaaacgggtaaaagttttgcgtgtggaccgcttcaggacggtgtgttccgtgtcaggttggtgccgtctgaaacgtgcagccgtttgaaaaccagcgatgatgcaagggtgatgccgccgatgctgagcagggtcatacggaaggcggaatgcagacctgaagaagccggtatcagaaatgtccagtttttaaggattaatgcgccggcaacaatgcccatgctgatggcaagctgttggttgaccgccatcaggctgttgccgctgcctgtttgttgcgggcgcaaatcggcgagggtcagtgtgttcatggcagaaaactgtagggagttgcacgcgccgatcgccagcgagaggaaaacccaaatccacagcggcgagtttccgtcaggcagggcgagcagcatgatgaaggcggcaagcagcttggtgttccaaagcagtaccgtgcggtagccgaaacgtttcatgagcggtgcaatcagcggtttgaccagcagcgaagacagggcgacgggtgcgaccagccaacccgacaggcttgcgccgaagccgaaagcgatttgaaacatcaggggcatcagaaaaggaatcgagctgatgccgagacggctgaacagattgcccgccagtcccagacggaaagtgcgtatcagaaacaggtcggcggaataaatcggtttggacgcggttttcatatgtcggaaataacggcgtgcaaacagcagtccgccgcacagcggcaacagtgcaaaatacggaggcagcgcgtgcgacaggctttctgccgaaagtaacaagaggcacgcggcggcagaaaaaatcagataacctttgaagtctaaagagatattactgcctttaatatcgggcatgatgttgcgtcccaatatgaaacccagcagaccgatgggcaggttgagcaggaaaatccagtgccacgaagcgtattcgaccaaataaccgcccgccaaaggccctaaaaccggcccgattaatgcgggcataaccgcataattgatggcattgagcagcttggacttgtcgtacacacgcaagatggtcagacgcggtatcggaaccagcatcgaaccgccgatgccctgaacgacacgggaaagcgtcaattcaaacagcgaacccgatgcggcgcacaatgccgatccgagcataaaaacggcaatcgaaccgaaaaagacttttttcgttccgaacctgtccgccaaataaccgctcaaaggaatcagcagggcaaccgtcagcgtgtaggaaataactgccagttgcatatccagaggcgactcattcaggtcggcggcaatttcaggcagtgcggtatttaaaatggtcgcatccaacatctgcataaaaatggcaattgccagcagaagcggcagccaaggggatggtgcgcgggcggatagggtgtttttttccatagggcgattgtaccccatccttgtgccgttattgttttcagatgctgtctgaatgccgtcagagtcggcatcttgaatgttcacaagcaaacgaaccggcattgcattgtaatgataattattatcgaaaaccatcagattaaggtacagtaagcgttatgggggcagtttgtaagaaaaaccggattattttttaaaattagacttgacccgcaacagtcaattacttaaagtaaacgcttacctttctacagagaaaaacgggtttcccgttatcaaaaaacatgagcgcaaccattcccccaaaaatcatccgatacgacagcaatccgaccgatgtctattttttcggcacttgcgtccttgatctttttatgcccgaagcaggcatggatgccattaccctaatcgagcagcagggcatacgcgtccatttcccgatggcgcaaagctgctgcggccagcctgcctattcatccggccatccgaccgaagccttcgatgtcgccaaagcacaactcgaccttttccctgaaaactggccgatcgtcgtgccgtccggctcgtgcggcggcatgatgaaacaccactggccgacgctgtttaaaggcagcgagtacgaggaaagggctgtggattgcgccggccgcatcatcgagtttacccatttcctgcttgccatcggtttcaaacccgaagacaagggcgaaccgctcaaagtcgccgttcacacttcctgcgccgcccgccgcgaaatgaatgtccatctttcaggctggcaactgattgacggtatggaaaacgtcgaacgcatcgtccacgaccacgaaagcgaatgttgcggcttcggcggcacattctccgtcaaacaagccgatatttccggcgcaatggtaacagacaaagtcgccgcgctgaaagaaaccggcgcaaccgaaatcatcagcgcggactgcggctgtatgatgaacatcggcggcaaaatcgccaaggacgagccggatatgccgcgtccgaaacatatcgcatccttcttgttggaacgcaccggaggcaaagcatgagcgcgcgtgaaaatattttggcaaaactgaaaaaagccgacgcattgccgatggaagaacctgcggtttttgattattaccgtgaaatgggtgtttcttggggcagcgaagttgagcgtctgaaacattgggctgccgctatgcgtgcggtcaaaaccgaaatttattgggtgacgaaaagcaattggatgcaggttttccgcgaagcggcagaaggcaagggtttgaaaaacatcctgctgcccttggcgaccgaacacggacaaattgcccgtgccgcattggcggacagcaatatcgaaccgattgccttcgagcgcgaaatcgatacttggaaaaccgagtttttcacgaacatcgatgcgggcttcagcggcgcgcaatgcggcatcgcccgcaccggcacgctgatgctgttttccagccccgaagaaccgcgtactttaagcctcgttccgcccgtgcatttctgcctgttcgatacgtccaagatgtacaacgagtttcataatgccgtcgaaggcgaaaaactggtggaaaacggtatgccgaccaatgtattcctgatttccggcccgtccaaaaccgcagacatccaactgacgcttgcttacggcgcgcacggcccgcgcgatttggtcatcctcgccatcctgcccgaccacatttcccctgccgatttggaggaaaacgcatgactacgcaaaccatcaaatttcacatgaagccggaaactttcaagcaaaacgccgcaatttcccttcaagacaagcctttgcgcaaaagcctgcgtaccgcgatggatatgctgatgaccaaacgcaaagccgttttgaccgacgaagaagagctgcaaagcctgcgcgatttgtgcgaacacgtccgtcagcgctcattgtctaaattgccagccctgctggagcagctggaagaaaacctgactaagttgggcgtgaaagtgcactgggcagaaaccccgaccgaagcctgccaaattatccacgacatcatcacagccaaaaacggcaagctgatggtcaaaggcaaatcgatggtcagcgaggaaatcgagctgaaccattatcttgaagcaaaaggcattaaagcggtagaaagcgacttgggcgagttcatcgtccaaatggcaggcgaaaaaccgacccatatcgtgatgcctgctatccacaaaaccaaagaacaggttagcgaactgttccaccaaaacctcggtacgccgctgacagacgatgtagaccaactgaccggcttcgcccgtaaagcactgcgcgatatttacagcactgccgatgtcggtttgagtggcgtaaactttgccgttgctgaaacaggtacgctgtgtctggtggaaaacgaaggcaacggtcgcttgagtaccaccgtaccgcccgtgcatatcgctattaccggcattgaaaaagtggtggcgaaattgtccgacatcccacccttgtacagcctgctgccgcgttctgccattggtcagaacattaccacttatttcaatatgattaccggcccgcgccgcagtgaagaattagacggtccgcaagaaatgcacttggttctgctcgacaacggccgcagccaggcttatgccgaagaccaaatgcgccgcaccctgcaatgtatccgttgcggcgcgtgtatgaaccattgcccggtttatacccgcatcggcggcgcggcatacggcacaacctatcccggtccgattggcgagattatttccccgcacctgttaggcttggatgccactcgcgacctgccgaccgcctgcacgatgtgcggcgcgtgcgtggaagtttgtccggtacgcatcccgattaccgaacaaatgcagcgtttgcgcgttgaagcgcaacgttcgccgaccgaaaccgtgccgcaccccatccgggggcaaggcgcatcgcataccttcggcgaacaaatggcgtggcgcacattcaacggtattttcagcggcagcaaaacctaccgcgccttcggttgggcagccaccaagttccgcaacctgaccccgcgcaaacagttgggttggacgcaaaaccgcgtgccgatgaaaccggcgaagaaaaccctgcacgaactaatggcagaaaaaatgcgccaaaaagaacaggcataaaaagttgttcgcaaaaatgccgtctgaaacccgaaacagggcttcagacggcatttgtatagtggattaacaaaaatcaggacaaggcgacgaagccgcagacagtacaaatagtacggcaaggcgaggtaacgccgtactggtttaaatttaatccactatatattcgcagacggtgggttttaaatttgttccaattccatattcaaaacagcctgttcctgtttggctcggaagtctgccagtttttgcgccagttcgggggtttcgttggcgagcatggaaacggcgaacaatgcggcatttgccgcgcctgcctcgccgatggcgaatgtggcgacgggtacgcctttgggcatttgtacaatcgataaaagcgaatcttcgccgcgcaggtatttgctggggacgggtacgcccaaaacggggacggtggtcttggcggcaaccataccgggtaaatgcgccgcgccgcccgcacccgcgatgatggctttgatgccgcgcgcccgtgcggtttcggcgtattggaacatcaaatccggggtgcggtgtgcggaaacaacgcgcgcctcatattctacgccgaactcttcaagaaactgcgctgcctgccgcataacgggccaatcgctgttgctgcccatgatgatgccgatttgtatcataaatcctccttggtgcggatggggtaaaaagcggaaaaatggaaaaactatcgtttgcgcacggctgcggcggcgcgttttgccgccgggctgccgggataggtctgtatcaggctgcgccaagtcgcccttgcaatgtctttttgctgaagcctgtattggcattcgccgattttgaacatggcttcaggcgcggttgggctgtctttgaaacggttggcgtaacgccctccgatttcgatgacggattcgcagttgcccatacgcgccctgctttgcagcaacaggtacatactgcgttgcgcgatgctgccgccgtcgcctccgtccgcgcctttcaacagggaggcagcggcagaaaacttgccgcttttatagtgtttgagtgcctgattgtagaggttttgtgcggtttcgacagtatgtgcggatgcgctgccgccttcggtattgaggtaatgctctttcaacttgcggtcgtcgagtttttggacgtatgccctgccggaagaatgtgtttttgcgtgttccagtgctttgactttgccgtttaaggtttccacttcgttcgacagccggacgattttgccttccagatagtccaaacggtcttgcaaggtcggaacgggatagggaatgccgtctgaagcattttcccgtgtcgacatttcggtttggctgcctgccggaacgggtgaaacggaagcacaggaggcggacacagacagccaaatgataaaaagcggtaatttgatcttcattattttttcagaagcagggtcaagccgtcgccgacgggcagggtgatggggacgatgcgcgggtcgttcggcaggttttgattgaaatctttgaggatgccgacgctgggcggcgcatcggaagccgcttcgcgcatcacccttccgttcagcaaaatattgtcgatggcgatgatgccgccttgacggacgagtttgaggcaacgctcgaaatattgcggcgtgggcggtttgtctgcgtctatcagtgccaaatcgtagcttccggcttcaccctgtgcaatcaaatcatccaatgtcagcaatgcgggttgcaggtgcaggctgattttatgtgccacaccggcctcgttccaaacctgacgcgccgtatcggtaaaggttacattgatgtcgcaggcggtaatccgcccgtgttcgggcagtgccaatgcaagcgcggtgctgctgtatccggtaaatacgccgatttccagatatttttccgcacggatcagctttgccagccaaaccaaaactgccgcctgttcgcgcgcaatcgccattttgcccatacggtgatgcccggtcttctcgcgcagccgcgtcaaaacgggatgttcgggttcgccgatggcgttcaaatagttttgcaggtccggtgcgacattggacagatgggtcgtcatttcggcggattcagtcttggtaataggtataaggttttttcgccacttttgccgcctcgaagttttcctgttcttcgggattgagttcgacatcccacaaaagccccctgttttccaaacgctgctgttccaactcaggtttttcttcaatcaggcggttgaggaattgtgtggcatcggattggtagtgatacatctttgtgctccaattttacggaatatggcgtgattatactggtattttccaaacgggataaacggcttttatcaagaatacgggcagaaagataaggggttttattatagaataagacgttttttgcaacggaagcccgccttatgtcccgaatcgccgccctgcccgaccatcttgtcaaccaaatcgccgccggcgaagtggtcgaacgccctgccaacgccttgaaagaaatcgttgaaaacagtatcgatgcaggcgcaacggcgattgaagtcgagctggcgggcggcggcatccgcctgattcgcgtcagcgacaacggcggcggcatccaccccgacgacatcgaacttgcgctccaccgccacgccaccagcaaaatcaaaaccttaaacgatttggaacacgtcgccagtatgggctttcgcggcgaaggtttggcaagcatcgcctccgtcagccgcctgaccctgaccagccgtcagaacgacagttcgcacgcgacccaagtcaaagccgaagacggcaaactcagcagccccaccgccgccgcccaccccgtcggcaccaccatcgaagccgccgaactcttcttcaacacccccgcacggcgcaagttcctcaaatccgaaaacaccgaatacgcccactgcgccaccatgctcgaacgcctcgcgctggcgcatccgcacattgccttctcgctcaaacgcgacggcaaacaagtgttcaaactccctgcacaaagcctgcatgaacggattgccgccattgtcggcgaagactttcagacggcatcattgggaatcgacagcggcaacggcgcgctgcggctctatggtgcgattgccaaaccgactttcgccaaaggtaaaaccgacaaacaatactgcttcgtcaaccatcgcttcgtgcgcgacaaagtgatgctccacgccgtcaagcaggcataccgcgacgtattgcacaacgcactcactcccgccttcgtcctctttctcgacctgccgcccgaagccgtggatgtcaacgtccacccgaccaaaaccgaaatccgcttccgcgacagtcagcaggtgcaccaacttgtgttccacacgctcaacaaagcccttgccgacacacgcgccaacctgaccgaaagcgtcggcaacgcaggcgaagtgttgcatgacattaccggcgttgtctccaccccaatgccgtctgaaaacgacagcgaaaatctgtttgatagcgtatccaactacccgacaggcaacaaatcagatacacacaatgcctttggttcatcaggcaaaaccgcgcccatgccctatcagtccgcatatgcgccgcaacaacgcagcctgtccctgcgcgaaagccgcgcggcaatgaatacttacgccgaactttacaaaaaaaccgacgacatcgaccttgagttaagccgattcgagcaggcacgtttcggcaatatgccgtctgaaacgcctgctccccaaacagatacgccgctttcagacggcatcccgtcccaatccgaactgccgccgctcggttttgccattgcccaattacttggcatctacattcttgcccaagccgaagacagcctgttgctcatcgatatgcacgccgccgccgaacgcgtcaactacgaaaaaatgaaacgccaacgtcaggaaaacggcaacctgcaaagccaacgcctgcttattcccgtaacctttgccgcgtcccacgaagaatgcgccgcccttgccgattatgccgaaacgctggcaggcttcgggctggaattatccgatatgggcggcaacaccctcgccgtccgtgcagttcccgccatgctcggcaaagccgatgtcgtctcgctcgccaaagacgtattaaacgaactcgcccaagtcggcagcagccaaaccatcgaggaacacgaaaaccgcatcctcgccaccatgtcctgccacggctcgatccgcgccggccgccggctcaccctgcccgaaatgaacgcccttctgcgcgatatggaaaatacgccgcgcagcaaccagtgcaaccacggcaggccgacttgggtcaaactgactttgaaagaattggacgcactgttcttgcgcggacagtaagccgaaagtgctagaatacgccgcccgagaccgccgttcagacggcattccgacgcaccgacagaaacatcacgaccgaaaccaagagaaaaacatggcctatcaagttctcgcccgaaaatggcggcccaaaacctttgccgacttagtcggtcaggaacacgtcgtcaaagccctgcaaaacgccctggacgaaggcaggctgcaccacgcctacctgctgaccggcacgcgcggcgtaggtaaaaccaccatcgcccgcatccttgccaaaagcctcaactgcgaaaacgcgcaacacggcgaaccttgcggcgtatgtgaaagctgtacgcagatcgatgccggacgctacgtcgacctgctggaaatcgacgccgcctccaacacaggcatcgacaacatccgcgaagtcttggaaaacgcccaatatgcaccgaccgccggaaaatacaaagtctatatcatcgacgaagtgcatatgctttccaaaagcgcgttcaacgctatgctcaaaacgctggaagagccgcccgaacacgtcaaattcatcctcgccaccaccgatccgcacaaagttcccgttaccgtcttgagccgctgcctgcaattcgtcttacgcaatatgaccgcgcaacaggttgccgaccacctcgcccacgtcctcgacagcgaaaaaatcgcctacgaacccgccgccctgcaacttttgggacgtgccgccgccggatcgatgcgcgatgccttgagcctgctcgaccaagccatcgccctaggttcgggcaaagttgccgaaaacgatgtccgccaaatgatcggcgcggttgacaaacaatacctttacgaactgctgacaggcatcatcaaccaagacggcgcagccctgaccgccaaagcgcaggaaatggcggcgtgtgccgtcggctttgacaacgccttgggcgaacttgccatactgctgcaacacctcgccctgatacaggcagtgccgaatgccttggcgcacgacgaccccgattccgatattttgcaccgcctcgcccaaaccataagcggcgaacaaatccagctttactaccaaatcgccgtccacggcaaacgcgacctcagcctcgcccccgacgaatacgccggctttatgatgaccctgctgcgtatgctggcgtttgcgcccttggcggcagcatcgtgtgatgcaaatgccgtgattgaaaataccgaactaaaatccccatcggcacaaaccgccgaaaaggaaaccgccgcaaaaaagccccaaccgcgccctgaagcggaaaccgcccaaacacccgttcagacggcatccgcagcagcaatgccgtctgaaggcaaaactgccgaacccgttaccaatcaagaaaacaacgatattccgccttgggaagacgcgccggacgaaaccgcagccggcacggcgcaagcatcggcaaaaagcattcagacggcatccgaagccggaacgccgcccaaaaaccaagtttccaagaacgaagcagccgacaacgaaaccgatgcccccttgtccgaagtgccgtctgaaaaccccattcaggcaacaccgaataatgaagcccttgaaacagaagcatttgcacacgaagctcctgcaaaacctttcaacggttacagctttccgaatgatgactacctcgtagaagacggcgcagaaatcccaccgcccgattgggaacacgccgcccctgccgatgcggaagaagaaaacaacgccgacgaaagcagcaacaacgaagaccacacgccatacgccccgccgcccgaattttccaccgaaaactgggcagccatcgtccggcacttcgcccgcaaactcggcgcggcgcaaatgccggcgcaacactccgcgtggacggaataccatcccgacaccggtctgatggttttggcaatgaccgccgaagcacgcgccaccgccgacaaaaaacgcctcgacaaaatccgcgacacccttgcccaagcctacgggctgcaactcaccctgcaaacccaagactggcgtgacgaagccggccgggaaacccccgcgatgcaggacaagcgcgtccaagccgaagacaggcaaaaagcacaagcattgctcgaagccgaccccgccgcacaaaaaatcctccaagcattcggcgcgcaatggcagcccgaatcactggaattggcggcaaaccggccataaacagatataatgccgcccgaacccttcggacggcattgccgtttcccttattcaatcaaaacagacaggagtattcagtatgttcggaaaagccggattaggcggcctgatgaaacaggcgcagcaaatgcaggaaaatatgaaaaaagcgcaagccaaactcgccgaaaccgaaatcgaaggcgaagcaggcaacggcctggtcaaaatcacaatgacctgcgcgcacgaagtacgcaaaatcgacatcagccccgatttgattcaagaagccgccgacgacaaagaaatgcttgaagacctcatcctcgccgccctcaaatccgcccgaggcaaagccgaagaaaccgcaaacaaaacaatgggcgcattcacgcaaggtctaccccccggagtgggcgacttcttccgctgatccccgaccgtcattcccacgcaggcgggaatctagaacgtagaatctaagaaaccgttttactcgataaatttccgtgccgaggggtctggattcccgccttcgcgggaatgacggcatcagtttgcaggattcggcgtgaacggtaaaaacagtgagaatgataagaacgcaaaaacggcaagaatagcgggaatcggcaggctgaagcccaccctaccattatttacacatccgtaccgcttaaatgccgtctgaaacttcgtcattcccgtgaaagcgggaatccaaccccgtcggagcagaaacttacaccccgtcattcccgcgaacgcgggaatccagtaaccgaaaaaccacaggaatctatcggaaaaacagaaaccctcgaccgtcattcccgcgaacgcgggaatccagtaaccgaaaaaccacaggaatctatcggaaaaaacagaaccccccgaccgtcattcccgcgaacgcgggaatctagaacgtagaatctgagaaaccgttttactcgataaatttccgtgccgacgggtctggattcccgccttcgcgggaatgacggcatcaatttgcaggattcggcgtgaacggtaaaaacagtgagaatgataagaacgcaaaaacggcaagaatagcgggaatcggcaggctgaagcccaccctaccattatttacacatccgtaccgcttaaatgccgtctgaaatttcgtcattcccatgaaaacgggaatccagccccgtgggagcagaaacttacaccccgtcattcccgcgaacgcgggaatccagtaaccgaaaaaccacaggaatctatcggaaaaaacagaaccccccgccgccgtcattcccgcgaacgcgggaatctagtaaccgaaaaaccacgggaatctatcggaaaaaacggaaacccccgaccgtcattcccgcgaacgcgggaatctagaacgtagaatctgagaaaccgttttactcgataaatttccgtgccgacaggtctggattcccgccttcgcgggaatgacggcatcagtttgcaggattcggcggaaacggtaaaaacggcagaatcgatgggatgcggcaggctgaagcccaccaaaacacaaaaattccgatgccgtctgaaatttcgtcattcccgtgaaaacgggaatccagccccgtgggagcagaaacttacaccccgtcattcccgcaaaagcgggaatccagtaaccgaaaaaccacgggaatctatcggaaaaaacagaaccccccgccgccgtcattcccgcgaacgcgggaatctagaacgtagaatctgagaaaccgttttactcgataaatttccatgccgaggggtctggattcccgcgttcgcgggaatgacggcatattttttgcatttgatataaagggtcgtttgaattttgttcagcaagtgcaaagtgttgcacataaaagggcgcaggatagaggcaaagcgggcgtaggtcgggctgtagcaactgtatttttcaccccgtcgggcaaaaatatagtggattaacaaaaaccagtacggcgttgcctcgccttagctcaaagagaacgattctctaaggtactcaagcaccaagtgaatcggttccgtactatttgtactgtctgcggcttcgtcgccttgtcctgatttttgttaatccactataccaaaactcaaatcaagccgttcggaggcggctcaaaaaaacggtacttcgcagcagaagtaccgtttatcgggatttcaggttttattcttcggggcgttcgccgtcggtttcgtcctgcgtcccttcggtgatgtgcatttctacgccgttgagggcgcggatttttgcgtcgatttcattggcgacttcgggattttccttcagccagacgcggacgttgtctttgccctgaccgattttcgcgccgttgtagctgtaccacgcgccggatttgttgatgatgtcgtttttcacgccgatgtcgatcaattcgccttcccaactgatgccttctccgtagaggatgtcaaactctgcctgacggaacgggggggcgactttgtttttgatgactttgacgcgggtttcgttgcccaatacctcttcgccttttttgatggatccggtgcggcggatgtcgaggcggacggaagaatagaatttcagcgcgttgccgccggtggtggtttcggggctgccgaacattacgccgatcttcatccggatttggttgatgaacacaaccagcgtgttggtttttttgatgtgtccggtcagtttgcgcaaagcctggctcatcaggcgcgcctgcagtccgacatggctgtcccccatatcgccttcgatttcggctttggggacgagtgcggctacggaatcgacgactaccatatctatgccgcccgaacggacgagtgtgtcgcagatttccaaagcctgttcgccggtatcgggctgggacaggtaaagctcttcgacttttacgccgagtttgcgggcgtaaacgggatcaaaggcgtgttcggcatcgacaaaggcgcacacgccgccgtttttctggcattgggcgacggcttcgaggcagagggtggttttgccggaggattcggggccgaagatttcgacgatgcgcccgcgcggcagaccgccgactccgagggcgaggtctaatccgagcgatccggtggaaatgacttcgaggttttcttcctgctggctgccgtccattttcatgatggcgcctttgccgaaacttttttcgatttgcgccagtgcggcggcaagtgctttgcttttgtcgtctgacattggggttactccggaacaaatgcggtatgtgggatgcggcgcaacacgggctgcggcgcgggatgtgtatcgttttcccgatgtgcgggctatcggtaatgctgcttcacgaggttgccattatcgcatatttccttgcttgccgatatgcgccaggacgcggcggcttgtgccggaatggaatctggatgccgtctaaaaggcggccggctttgttataatggcggctgttttttctgtgtgtgcctgttttatgtgttcctgccttgttgtcaaaaataccgttatcggaagcggacgcaccaaaatcgccgtgccgcttgtcgcccgcgatgccgccgaactttccgccgtacttgagcaaatcaaaaatatgcccttcgatattgcggagttccgcgccgactttttggaatgcgcgggcagtatcggcgaaatattgcaccacacgcagaccgtccgcgacgcgctgcccgacaagccgctgctgtttacgttcagacggcatggcgaaggcggctcgttcccgtgttcggacgattattattttgaactgctcgacgcgctgatcgaaagccgcctgcccgacatcatcgacatcgagctgttttccggcgaaaccgccgtccggtgcgccgtggcaaatgctcaaaaaaacggcatcgccgccctgctctgcaatcatgagtttcaccgcacgccgccgcaagaagaaatcgtatgccgtctgaaacagatggaggactgcggcgcggacatctgcaaaattgcggtgatgccgcaaagcgcggaagatgtgctgactttgctttccgccacgctcaaagcgaaagagcttgccgccaaaccgattgttacgatgtcgatggggcagacgggggcggtcagccggcttgccggacaggtgttcggctcaagcatcacgttcggttcgggaacgcaaaactccgcgccggggcaaatcggcgtatccgccctccgtgcgacactcgactgcctcgaaaacggcgcagactgatttcagacagcatcaaaacatgatgaaactcaatccccaacagctcgaagccgtccgctacctcggcggcccactgctcgtccttgccggtgcaggcagcggcaaaaccggcgtgattactcaaaaaattaagcatttgattgtcaatgtcggctacctgccgcataccgttgccgcaattacctttaccaacaaagccgctgcggaaatgcaggagcgcgttgccaaaatgctgcccaaaccgcaaacgcgcgggctgacgatttgcacgttccactctttgggcatgaagattctgcgcgaagaggcgaaccatattggttacaaaaaaaacttctccattctcgattctaccgacagcgcgaaaatcatcggcgaactcttaggcggtacgggcaaagaagccgtattcaaggcgcagcaccagatttccttgtggaaaaacgatttaaaaacgcctgaagatgtcgttcagacggcatcgaacatttgggaacaacaaaccgcacgcgtgtatgcgagctatcaggaaaccttacaaagctatcaggcagtggacttcgacgacttaatccgcctgcctgccgtgctgttgcagcaaaacagcgaagtgcgcaacaaatggcagcggcggctgcgttatctgttggttgacgaatgccaagatacgaatacctgccaatttacgttgatgaagctgctgaccggcgcggaaggtatgtttaccgccgtcggcgacgacgaccagtccatctacgcatggcgcggtgcgaacatggaaaacctgcgtaaaatgcaggaaaactatccgcagatgaaggtcatcaaactggagcaaaactaccgctccaccgcgcggattctcaaaatcgccaacaaagtcatcgaaaacaaccccaagctgtttaccaaaaaactttggtcgcaattgggcgaaggcgagccggtcaaagtcgttgcctgccaaaacgagcaacacgaagccgactgggtcgtcagccaaatcgtcaaacaaaaactcatcggcggcgacaaaacccaatatgccgatttcgccgtgttataccggggaaagcatcaggcgaggattttcgaggaagcattgcgcggcgcgcgcatcccctaccagctctccggcggacaaagctttttcgacaaagccgaaatcaaagacgtgttgtcttatgtgcggctgcttgccaaccccaacgacgatcccgcctttctgcgtgccgttaccacgcccaaacgcggcatcggcgatgtcacgctgggcaagctcaacacttacgcgcacgaacacgaatgcagcctgtatgaagccgcgcaaaacgaagaagcccttgccacgctgaacaataccaaccgccaacacctgcaaacctttatggatatgttcgtcagctacctcgccaaagccgaaaccagcgaagcgggcgagttcatcaacagcctgctcgaagaaatcgactatgaaaaccatttgatgcaaaacgaagaaggcaaagccggcgaaatcaaatggcgcaacgtcggcgatttggtatcatggtttgcgcgaaaaggcggggaagacggcaaaaacatcatcgaactcgcccaaaccgtcgccttgatgacgcttttggaaggaaaagacgaagaagaaaccgatgccgtctcgctatccacgctacacgccgccaaaggtttggagtatccgtatgttttccttgtcggttgcgaagaaggcgttttgccgcacaacgacagtatcgaagagggcaacgtcgaagaagaacgccgcctgatgtacgtcggcatcacccgcgccaaacgccaactcacactgacccactgcgtcaaacgcaaaaaacaaggcacatggcagttccccgaacccagccgattcatagacgaaatgccgcaggaagatttgaaaatcctggggcgcaaaggcggcgaaccgattgtcagcaaagaagaaggcagacgcaaccttgccgatataatcggaaggctcgacaacctaaaaaaaagcggcgcggcggattaaaccggagccgcaatgccgtctgaaggcttcagacggcatattttttggacggcgcgcgtaaagcggtttacgcccacaaatcctgctgctggtttttcggcacaagatgccccacgccgataccgataaggcggaacgcgtcttccgtctgcggcgagacgcgcgccatcaacatttgcgcagcctgcagcagagtgcgcagtcgggcaatacggaggaataagtcagtgtgcgcgtgatgatgcggaaatcgtaggtcttcagcttgagcgttacgctttgggcttcgacgtttttgcgcgtgatttgccgccacaagtcttcggcaagatgggggaggtgtccggcagcctgctcgagcggcaggtcttcgggcagggtaatttctgtggagatttggaggcgttcgcgttcggctttgacggggcgttcgtccgtaccgcgcaccaaatcatagaggcggtatccgtagcgtccgaaatggtttaagagttcgccgcgctcgaaacggcgcaagtcgcccgccgtccgcatacccagcgactgcatttttttcagcgttaccttgcccacgccggggattttgcccaaaggcagggtttccaaaaatgccatgactttgtgcggcggcaacacaaactgcccgttcggcttgcgccagtccgacgcgattttcgccagaaatttgttcggcgcgatgcctgcggatgcagtcaaacctgtttccgcaaaaatggcggcacggatttctttggcaacgtcgccggcgtaagggatgtttttgaaattacgggtaacgtcaagataggcttcgtccagcgacaagggttcgattaaatcggtataacgcctgaatacggcgtgaatctgcgcggaaacctgacggtacaaatcgaaatgcggcggcacatacaccgcttgcggacacagccttttcgccgttgccaccgacatcgcggaatgcagcccgaactgccgtgcctcatacgatgcggcgcaaatcaccgaacgcgcgccctcccacgcgacgaccaccggccgccctttcaaatgcggctgttcgcgcagctctaccgatgcgtagaatgcgtccatgtcgatgtggataattttgcgtgaagacatcggctcttctgaggataaaagggatattctactgccggcatcgggcaaattccaaatatacgccccgatagacctgcctccataaaaatgccgtctgaaacataccctgtttcagacggcatccgcaaaactacggttttcaattaaaactgccaatccagtttcatgctgacagtgcgcggctctccgtagaagttgtttgcgccgcgcgtacggttgtagttgttctcaaaataagtgcgtccgtttaagttcgtaccgatgaggctcaatttggcgtgtttgcccaattcgtaacggacgaaaccgtctatcagcccgtagccgccctgcctgatgttatacagactgcttgtgccgctttgtgcggacacgccgccgccgacggtcagccccgtattcggtatatggaagctcgttccgaaacggaatatgtgcacgggtgtgaaattgctgaagttgtacgggtctgcactggaatttttggcaaggcgttcggcgttgacttcggcggcgtttttgtagcggctcttgttgtaggtgtaacccgcaaagactttccaatcttcgttcaactcacccgacaactcgaattccgcacccctgctgaccactttgcctatcggtttggcaacggtttggaacgacccctgcttgccgcctgctccgggaacatagccgaaatcgacgaccgtgcggtttttctgttcgaggtaaaacaatgcgaacgaagcattcagccgtccttgcaagaacgcgcctttccagcctacctcatagtttgtgccgaccaaaggcggtaaaacggttttggcactgacatcgacattatcctgctgtttgaagattttggtataacttccgtaaatactctgttgcggtgtcaagtcataggtaatgcctgcatagggcgtcaatttatgaccttgcatcttggccgtgtaatggtcctgatccgccctaatgctcgatgccgtctgaaaatcgcttgccggctgcccatagcggacaggcatatctttggtttgcgaagtctcatagcgcgtgtagtgcagcccgcccaaaaggtgcagtcggccggttacgttgaaacgcgtgctggcagtcagcgaatgggttttgttggtgttgaggtatttggcgtagttatacagcgcaggaacatggtcgtctgccactttgacggttttccaaaccggcaccgtaccggaaaaaccggtaaaggcaggcgtgccgtcgggattggtctcctgaatcttgttgcctttttcgtccagctcatatacatcgacatataccggtgtccggctgccgctgtattcgtcatagtaatacacctgcttgccttcggcatcgagcttgggctcggtttttattttcttggcgttcctgcattcttcggcataaacggtacggttgcctttttcatcgtacgcctgccaatcgggttctttatgccccctgaccaaaggagacgacaaatcgccgtccggctcctcctgacaacttcccgcatacacgccgtgcgttgcccccgtattcggacgtactctgtagcggcgttcgtagatttctagatattccgaacgtatcttttcatcaccgtaggcatagccgacaaagaaatcatgctcccgcccgaacagcccatatgtgccggtcaggtcaagtttaattccccattggcggtcgtctttggtatgccgcaacggcatataactgtatcgtcggttggcggtagccttccgattaaaggaagagtcatacaggctgtttggaaaacgttgtgccgcattattaaagatgccctccttcgcaagggctttatcgacaaattccgccttgtcggcatcaacgcccggatccccccaagaaccttgacagataaagtccagcgcgaaagggtcactcatacacttgtcaaaaccggctttgcgttctgcggcacggcggctgcgatactgttcgaaagcagtattatcgaaacggtttttaacaaaatcgtctttgcgctcccggtattccttggcggtttcatcacgatatgctttcagtttctccaatgccttatctttcggctcgaacgggatgacttcgtttttttcagtcaaaaagcctaccgcatcctcacccgacaaacccgccgcatattcgtttttcagaaaaaactgccccaccttcgcatcggattcattcttggtataagacacttcggcattgagctgccaaccgttgtcaaacacatgtttgaatcctgagaaaaggttgtatttgtcggcacttaaccgcgaccaatcctcccccaaataagtgttgcgcggcagttgcaaaggccggttgcaggcaggcgttgaactgaacggggcagttttctgattttcacagggcaaaataatgcccgaaaaatcaggaacctccctactcttctgatacatgccgcccaaagtaagcacactgctgtcgcccgcatcggcttcggcaatgccgtaaaccatatgtttcctgccccaaactcggtctttaaacgattttttatactcttccgcacccaccaaccttccgcgtaaggtattcgccttattcaggctgcctgaaacatccaacactgcacgccggctgccgcgatggtcggcggtcagctctccggtatgtttgaaagaagcggtaggtcacttacggatcaaattgacggttcctcccggctctgaattggattgggtcaaccccgttgcaccccgtacaacttcaatatggtcataaaccgccaaatcggtactcggagacacgtcgattttcgccgtatatcccgaacggcctgcaacattgacggtcataccgtcttcaccaatctgatcaatatagaaaccgcgtgacaaaaaccgcgtctgcaagcctgaatcgcgcacaacgttgacacccgtcgtgtttttcattgcctcttcaagcgtatgcaccgccttatcgtcaaggcggctgcgcgtgatgacgctgaccgactgcggcgtatccttgcccgcaatcctcatacctgtggcggtggacatccgatctatcgtataagaacgggtcttttcggtcttgcccaacaaagcatgagagccgcgtacattgaccgtatccagactgacggtattgccgtctgaaacaggcacaacaccgtctgcaaaagaaccaccgtaagccgataacagcataacggtcagaattttaagtgaaaaatgattttgattcatagagacctctgtaatatgcaagtgtgcaaatcgtccaaaggctctcacaactgttttgattttttatattaattgaaaaaaagtaattctcaattaaatttatagataggattgtattcccattttgacaaaaaacaaactactccttaccgtttatttcaaaaaacgataacattgtattgaaaaatatccgaatttaaatacagaccgccaatgcagaaaaaaacacccaaattggctataatcccgacaaacacactcaaggacaacaacatggcagcctcgcccgaagcaaaattcaccgaagaaaagattttgtgggtcaaacaccacacgccgaaactcatcactttcgccatcagccgtcccgaatcctaccgctttaaagccggacagttctcccgactcggtttctacgaaggggaaggtttcatttggcgtgcctattccattgtttccgcagaatatgccgacacgctcgaatattttgccgtactcatccaagacggccccatgtcggcccgtttcgccaaaatgcaacagggcaacaccatcctgctcgataaaaatgccaccggcttcctcctgcccgaacgcttccccgacggcaaggatttggtgatgctctgcaccggctcgggcatcgcccccttcctttccattctcgaacaacccgaaatccgtcaacgtttcgataccgtcaacctgatacattccgtatcttttcccgaagaattgattttcaacgaccgactcgccgcattgactgaacatcccctggtaggcgaatacggacactctttccgtttcgtccctgttaccacccgtgccgccaacccctcgggcttaagcggaaaacgcattccggaactcttaaaaaacaacagcatcgaacaggcgctgcataccaagttcaccccggaatccacacggtttatgatttgcggcaacccggaaatggtcaaagacactttccaaacgctgctcgacatgggttacgccatgcaccgcaaccgcattcccggtcaaatcatgatggaaaacggcttctaaaaaccaccctgcttgtccgatgccttcggatggacgggcaaaccgacacggcacgaaaaccgcgtcggcaaaaatgccgtctgaaaaaattcagacggcatcttcggatacattacctgcaaacggcaacacaccggcacaaaccgattaggcaatcaacacggtgacggctgtttacatacttgccggctttcaccaaccgatatcgatttaaccgatttccttaatatttttcctgtccgttttaaacttcgccttaaacgcatccggtaaatctttatcgaaataccaaagcccgtcatccatttccaatgcgccgcccattccgtgcagaacgactttttcccccgtcaaaggatcggtttcggtaatttccacctcatgcatttttccccaatccaaaacaggcaacttgtgtgcaaacgccaaaacctgttcgtcagaacggccgcacgccttatcgcatcggcctgaaacatatacgggacaaggctcatcctctgcataaccgtccggaaggataccggctgcggcaggacacaatccgtatgtttccgcccacgacgacaaagcccgtctcgctgcctttttattggcaaataatccggtaggcggattatccgtcacaccgtttttcaaagccgctgttttcgcattcaacatgccgtctgaacctttttcaaacctgacggtcgtaaatgttttaagcagatttttggcagacacataacaatccgaatgataacgcccgaccaattccgctttaatcttatatgcatgcaggctgcccaatgcgggaaaaaaacggacttcctccgtattgcaccaatcaaacggggcttttccggagtccaataaagccgaaatctcgctatatacccgttcaaacgtaccgatataatttactttccctccgccgtcgaaacaagccagcacccccataccgtcaggcaaaccgtacaactgttccctcaaccgttcgggcagcgcggcaggcagcggtttcggattcatcaaacggaaacactgcctgatccatgcctcaaccccgtgttccgacagactgtattccaaataatcacacaatgccgatacatccgccatcgcacgatgcctgtcttccacaacaatccccaacctttcgatgatactgtccaggctgtgcttgtaaaattgcggatacagacaccgggacagctgcacactgcacaaagcaggcgatgaaaatccgatacccgcacgatgaaactcatgctttaaaaacgtatagtcgaaacggctgttatgtgcaaccagcacacaacccttcaataccgaaaacaactcgccggcaatctctgcaaaaacaggcgcatcggcaaccatgccgtctgaaatccccgtcagccccgccacaaactgcggaatcggtttttgaggattaaccaaccactcatgcctcaccacccttccctgctcaaacttgaccaaagccacttcggttaccctgtcttcatacagattgccgcccgtcgattccaaatcaaccacggcaacaggcattccaaaccgtaaaaataccttttccagcaagggccagcgagaagcaacaatcattttattctctttaaattcaaacaacaaaccaatattttacacttttaaggcatttcatccaacaaaacaattgacagaatccgatgattaccctaaaattcgaatctttcttgcagcgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaaattctaaatccccgagattatcgctcggggattttttattgtctcagcaactcgttaccatatctttacctacccccttcatcagaatctcagacgtaatcgaatcatattcaaacctttgccgtgcaaaccgatatcccataaccggatgcggtgtccgtccaacattttacccgattgaaacgcctgatatattgcaccccatcaacgtggcattacttttcttaacaatcccctttgacagcaactgactagggcttttttatgccatcatcaaatttatagtggattaactttaaaccagtacggcgttgcctcgccttgccgtactatttgtactgtctgcggcttcgtcgccttgtcctgatttttgttaattcactataatattttctctcccgattgaaacaggcgtaacagaatgcccgaagctccggctgctttcttgtttaccgccgcgatatttagagtataataccaaatttgagcaatagttctaaaacagttagaaccatttttcatgagcctgactgattcgtacactcggagaaactgatgcagaatatttttgaccctttggttattcgtggaaaatcccttacccccatcgtgcaaggcggtatgggggtcggtgtttccgcatcgggtttatccagcgcggtggcgcgtgaaaacggtatcggaacgattgccagtgtggatttgcgccaccttcacgaagacctactcgccgaatcacaaatcaatccgagtgaagagaaatatacatctttgaactgtaccgcattagacagggaaatccaaaaagccaaaagcgcttcagagggaaaaggactgattgcggtcaacgtgatgaaggcggtcaaagaccacgccgcatatgtccgccaggcttgcgaatcaggggcggatgcggttgtaatgggtgccggcctgcctttagacctgccggaaatgaccgagggctatcataaagatgtcgcgctgctgccgattctgtccgaatcgcgcggtattaatatcgtcttgaaacgttggatgaaaaaaggcatattgcccgatgcgattgtagtcgaacatcctgcccacgcggccggacatttgggtgcatcaaccgttgaaggcgtaaacgatgccaagttcgacttcaaacgcgtgattgaggaaacgtttgaagttttcaaaagtttagggctggaaagcgaaaaaatcccgcttattcttgcgggaggcatggcaaattttgaaaaagtcaaaaccgccctaaagaactggggagcatccgccgttcaaatcggtacggcttttgccgttaccgaagaaggagatgcacaccttaacttcaaaaaaacgctcgccggtgcggaaactgaaaaagtagtcgaatttatgtctgttgccggtttgccggcgcgcggtgtccgcaccaaattcctagacagctacatcaagcgtgaaagcaaacttcagacaaacgccaaagccgacccgcgccgctgtacccaaggtttaaactgcctaaccagttgcggtctgcgcgacgggctttccaaagcaggacagttctgtattgatatccagcttgccgccgcattccgtggagaagtagataaaggcctgttcttcagaggtaaagaccgctgcccttcggcaatgccatccgcaccgtccgcgagacgatacaatatctgctgacggggagcgaacctgttgcaacgctcggacgctgacatcaggtaggatttgatttgcaaacaaaatgccgtctgaagggctttcagacggcgtttttcaggctgcgttccggaatagtgttaaaaaataaacgggatgagatacatttattttcgtccgacaaatcaaaccatcgcgccgaatgatcaaataatgcctgcacggcattacatctggcaaagcaatgcaatgaaaacacggcttttttatttgctttcagtattattgaaaagcttgtccatcggggtcaaatcgaccgcattgccttggctggtaatccatttgttctcgacgcgccacacgcctgccgcgtcctccacgcgcacataccagtggttggtcggcgaaagggttttgaacaccgcctcatattccgccctgccgttctgcgcgctgccgacgggcttgagggcgacggtttgatcgtccgccttgcgggtcgggtgcatcagcagcaggttcaaaggctgtttgccgtcaaactcgccgccgacaaacacttttgccgcattcatatcgggggaaatgagaacctgcaccccgatatgccgtctgacggcttcttcatcccgatgaagctggatgtcgatatgtttgccgtctttataataatcgtccgtaaccaaatctgtcgcgtgctgctgcgcgacaaaaaacatagcgacgctggcgatgacgacaaaaatcggccccgccatcaagatccacggccagacgtgtttgtaccaaggtttgattggagtgttttgagacacggttattctccgataaaggttgcatcttcttccaagacgaccggcttgccgtcgggcgcgccgctttcgcggtattggaaggtaaattcgatagggtggctgcctttgtccgcgtattccggaatggtggacacttggacgggaagggttaccgtttcgcgcggggcaaccttgataccgccttcgggcagcccggtcagggcgatttcgtcaaagcctttgacacttgcggtaatcagctgttctttttcacttttgttgatgatacgcaggctgtatgcgttttccagccagcctttggcgttttcgcgcaccagtacgccacggtctttcaaaatatcgacctcgaccattttgcgcgtggacaaaccggccaggaaggcaatgataactaacgccaacaccgcgccgtaacctgccacgcgcggtctgagcagccgttttttaatgtctttttcagaatattcgtgttccagcgcgctttcggtcgtataacggattaatccgcgcggatagcccattttgtccataatctcatcgcacgcgtcgatacaggcggcgcagccgatacattggtattgcagaccgttgcggatgtcgatgccgacggggcagacttggacgcacatcgcacagttgatgcagtcgcccaaacccgcctcttccttattgaccgttttcttgcgcgcgccgcgcggttcgccgcgttccgcgtcataagaaacaatcagcgtgtccttgtcgaacatcgcgctttggaaacgtgcatacggacacatatgcaggcatactttttcacgcataatgtgggcgaagaagaaggtcataaagccataaaacgctgcggcaaacatcgcgccgccacctgctgctccagtgaataaatcgggaacgaactggcggatagggacaaaccagcctgcaaacgtgatgcccgtccacgcgcagacaaggaaaatcagcaggtatttggtggctttgatgcggattttagtgaaattccacggcgatttttccagtttcagccgtttgtttctatcgccttcgaccaggttgtcaatccacagcataatttcggtgtaaaccgtttgcgggcaggaatagccgcaccacagtcgccctgcaatcgtcgtccaccaaaacagcccgaaggcgcaaatcatcagcagcaaggcaaggtaaatcaaatcgcccacccccaacgacaatccgaaaatgaagaaatgccgttcggggatattgaaaacgacggcctgcctgccgctccagttgaaccacggaatgacgtaaaacacaaactgcgtcgccaatacggcggcgatacgcagtttggcgaaccgtccttccgcctttttgggatggatgcgttcgccttcgggatggatttgaatcacgctggctcgcggatcgaatgttttttttgctttcggcgcggcttttgtttgttcggacgtgccgattccggatgccggactgccggcttggttttccgtggtcattctgcattccttagatttttgattgatggtttgcccgttaccgccgccgtttgcttttcagacgtcatttttcttgttttttaaggcgttgtgtttcaagttttgagaaaatccgtttttcccaaaatatatttccgctattgtacaactttatgcgccgtccggatgtatggggcggatacatttcccatccgcatcaaaacgcctggattttaccttaccgcccgaacaaaatccgaatacggttaaaaaaaaagactaaaaaaaccgacacccccatatcggcagaaccgacggcgcaagctcataaacaaacgctatcgacaatccggcacacaatctataactttttatttcaaaaggaataatggcaggcttcgcccgcaaatcgaaaatccttccccgcctgtcccctgccgccgccttcccacgcgtccgcccttttcttgaaagcataagcgaatcgggcgataatcaacgctttccgattatccacttatctgaaacaccagcaaggaaaatacaaaatgtctcaactggcaaacgcaatccgcttcctctcggccgatgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaccttgggcttgggcaaactgattgttttatatgatgacaacaatatttccattgatggtaaagtggacggctggtttaccgaaaacatcccgcaacgctttgaaagctacggctggcacgtcgttcccaatgtaaacggtcatgacaccgccgccattcaagccgccatcgaagccgcacgtgccgaaaccggcaaaccgtccatcatctgctgcaaaaccttaatcggcaaaggcagtgccaacaaagaaggcagccacaaaacccacggcgcacctttgggcgcggacgaaatcgaagccacgcgcaaacatttgggctggacttaccccgcctttgaaatcccgcaagaaatttacgatgcgtggaatgccaaagaacaaggcgcgaaactggaagccgactggaacgaactgttcgcgcaatatcaagccaaatatcctgccgaagccgcagaatttgtgcgccgtatggataaaaagctgccggacaatttcgatgaatacgttcaagccgcattgaaagaagtgtgcgccaaagccgaaaccatcgccacccgcaaagccagccaaaacagcatcgaaatcttggcaaaagagttgcctgaattggtaggcggttctgccgacctgaccccgtccaatctgaccgactggtcaaacagcgtctccgttacccgcgacaaaggcggcaactacatccactacggcgtgcgcgagttcggcatgggtgcgattatgaacggtttggtattgcacggcggcgtaaaacccttcggcgcgactttcctgatgttcagcgaatacgagcgcaatgccctgcgtatggctgcgttgatgaaaatcaaccctgtatttgtgtttacccacgattccatcggtttgggcgaagacggcccgacccatcaaccgattgagcaaaccgccaccctgcgcctgattccgaatatggacgtatggcggccgtgcgacaccgccgaatccttggtggcttgggcagaagccgtcaaagccgccgatcacccgtcctgcctgattttcagccgtcaaaacctgaaattccaagcgcgcagcgagcaacaactgaacgacatcaaacgcggcggctacgtcatcagcgaagcccaaggcaacgcccaagccgtcatcattgccaccggctcagaagtcgagctggctttggaagcgcaaaaagccctcgccgcgcaaaacatcgccgtgcgcgtcgtttccatgccgtccaccaacgtattcgaccgccaagacgccgcctatcaagccgccgtcctgcccgaaggcctgccgcgcatcgccgtagaagccggacacgccgacggctggtacaaatatgtcggactgaacggcgcagtcgtcggcatcaaccgcttcggcgaatccgcccctgccgatttactcttcaaagcattcggctttaccgtggacaatgtggttgatacggtgaaatccgtgctgtaaccccacacctaaacaaatgccgtctgaaaccaattagggcttcagacggcatttttatattctcgcggccatgatgctttctcatcccaccaatctccattataatatttgcgaatcactcttattcacatttcaaaaggagaaacgcatgagcacccgtaccgaacacgacacgatgggcaatgtcgaagtcccatccgaagcctattggggcgcgcagacccagcgcagccgcaacaatttcaaaatcggtggcgaaaccctgccgcagccgttgatttatgctttggcattggtgaaaaaagccgccgctgccaccaatgtttccctcggtaggattaagcctgaacaggcggatttgattacgcaggcggcggatgatgtgttgagcggcaagctcgacgggcagttcccattggtagtgtggcagaccggttccggcacgcagtccaatatgaacatgaacgaagtgctggcaaaccgcgccaacgaaatcgccggtacgggtttggcggcttatcagcccgtccatcccaacgaccatgtgaaccacgcgcaatcgaccaacgacgcattcccgaccgctatccacgttgccgccgcgattgaaatcaaccgccacctcatccccgccgtaaaagccctgcgcgacacgttggacaaaaaagcccaagctttcgcccctatcgtcaaaatcggccgcacccacttgcaagacgcgacgccgctgactttgggacaggaattttccggctacgtttcccagcttgatcacggtttaggccgtctgaacgatgcgcttaaagacttgtatgaacttgctttgggcggtacggcggtcggcacgggtttgaacagccatcccgaatacgccgaaaaagccgccgccaaactcgccgaattgtccggcttgccgtttgtcagcgcgccgaacaaatttgaagccctgggcggacgcgatgccgccgttgccgcttcgggcgcattgaaaacgctggcggcaagcctgaacaaaattgccaacgacatccgttggctggcaagcggcccgcgttgcggtttgggcgaaatcaaaatccccgaaaacgagccgggttcgtccattatgccgggcaaagtcaacccgacccaatgcgaagcaatgacgatggtgtgctgccaagtgttcggcaacgacgttaccatcggtatggcgggcgcgtcgggcaatttcgagctgaacgtctatatgcccgttatcgcctacaacctcttgcaatccatccacctgttgggcgacgcgtgcaacagcttcaacgaacactgcgccatcggcatcgaacccgtgccggaaaaaatcgactatttcctgcaccattccctgatgctggttaccgcattaaaccgtaaaatcggttacgaaaacgccgccaaagtcgccaaaaccgcctacaaaaacaacaaatcgttgcgcgaaaccgccgttgagttgggcttgctgacgggcgaagaatttgacgaactggtcgttcctgccgatatggttcatccgcgctaatccttccctcaaataaaatgccgtctgaaacctcgttcggacggcattttccgttgcctgcaaactagcggcgtttgaacagcctgtcccccaccgccgccgtaaccgcacccccgaccacgatcagtgcgcctgcataacccaaaccgttcatatccggcgcggcaaaagtatcaggcatcacataatgcccgagcaaagaaaatattacggtaaacacggggagcaaggttgttaccgcgctgactttggaagcctcccaatgtttcaacgcctcgccgaacgagccgtaaccgattaacgtattcaagcagcaatacgcaaaacaaacccacgccaacgtaccgtccaaacttccgatgtgtgccggttcggcaaacggcaggaacacggcggcacttgccgcataaatcaacagcagaatctgttgcggcccgaattgcgccgacagcagcttttgcgccacggcataacacacccatgccatactgcctgccgcacacagcaacacgcccttcgcatacgcgcccaaacccgacaactcgccgaatttatcgttaaaaaacataagcaaaccggcaagcagcaaaaccaagccgattttctgagcggcagtcatccggtctttaaacaccaacacaccgacaacaatcatcgtaaacggcgaaatctgccacaaaacctgcgtcgtggtcggcgaaatataatgcagcccttgggcaatcagcacaaagtttgccgaaatgcccgccacgccgagcagcagcagcctgaatgagcaccaagaaaaatcccgccgcttcggcagccgcccgcccagtgccagcaaaacaaacaataccgccgccgccacggtaaaacgcacccacaccagcgtcggcgcatcgacaaacttcaatacctgccgcacggcaatcggcagcgttccccacgtcatcgccgccaaaagtgccaacgcgaagcctaggagcggcctttggttttccatcctgattttcctatttttaaacaaccgtattgccggacgatgccggtttgccgcatcgggcaatgatggttcaagcgtttggcgtttgattccaaccctttgatttcaaacaaaccggctgaagctcggctattgcttcgcgctatttgaaaacaccgcctgaattttaaaatatagtggattaacaaaaaccagtacagcgttgcctcgccttagctcaaagagaacgattctctaaggtgctcaagcaccaagtgaatcggttccgtactatttgtactgtctgcggcttcgtcgccttgtcctgatttttgttaatccactataccgtctgaaaacagcggggacgtgcggcaggcatcactgcctcaaaacgcccgaacggcgcaatcgcaacgttccgcccaacgcaaagggcggcaacaagccggcccaaatgcaaaaaagagaaaccctgccccgtaaggtttaaggtttctccgtcctttatgatttccctccgcgaggatgtccggccgtaaaattcagaacgggatatcgtcgtcaatgtcctcgaccggggcggcggcaggcacgggttggcggcgcggcgcggctggtgcttcttggggatgggacggcgcgtcggaggcgggctgccggctttgctgcgcggggcgttggtaagcctcctgactctgaccgtaaccttcctcgtaaggcgcaccgccgctgttttcattgcgcccgcccaacattttcatttcgttggcgacaatatcgtaagcggtgcgttcgatgccgtctttgccttggtatttgcggctttggattctgccttccaaataaaccagcccgccttttttgaggtattgcccggcaatttccgccagtttgcggtacatggtgatgttgtgccactcagtacgctctacacgttggccgttgcggtcgttccaagtttcgctggtggcgacgctgaaattacaaaccgcctcgccgttgggcatatagcgcacttcgggatcgcgtccgaggcggccgatgaggatgactttgttcaatgacattttttaaactcctgtgatgattttttcagcggcagcctgatcgaaacccttctgcaacactttgagatagacggtctgcccgtcgaaactgaaaccgatgtcttccacaccctcaagctccgacaaggcgcggtataacccttcctgattgccctgccacacgccgccgacagggtaactgaggtttttgacgggcttgggcgcaggcgataaaacggcaattaccagccacagcagcatcaatatactgcaaaaggcaaacacgccggaaaagccgtatttttgaaacagcaaaccgcctgccgcgccgccggcaaacagtccgagcgactgcatcgtgttgtacacgcccatcgccgtacccttcaggtcggacggcgcgattttggaaaccatagacggcaggctcgcttccaacacattaaaaccgataaagtaaacaaccaaataagcggtaatcaagcctaccgagcgcataccggacagcaaaccgagctgcgccgccgcaatacagacgatacccaaaacaaaaacctgcttaagcttgttgcgcgtctcgccgacgataatcagcggaaccatcaccaccaagcccgtaatggtcgaaggcagatagactttccaatgctgtattttttccaaaccgagctgggtcatcgcgaaaggcagcgcggtaaacaatgccatttgtgcggcgtgcagggcgaaaatgccgaaatcaagcgtcagcagcctacggtttttcaaaacttcgcctatgcgcgaaggctgcgcctgcgtatcttcgtgcagcttggaaacttcgggatcgggagtcatccacgccaccacgccgatgctgatgacggtcagaatgccggtcagcataaacagtccgcgaacgccgaccgcgtcggcaatcacgggggcaacgacgaggctgaccgaaaacgtcaaaccgatactcaaaccgatcatcgccattgcgcgggtacgtacgccgtcgcgcgtcaaatccgccagcagcgcggtaaccgccgcactgaccgcccctgcaccctgtatggcgcgtgcggcgaccagcatgggcagcgtatcggcggcggcggcaagaaagctgcccgccgcaaacacgaccagtcccgcataaatggttttcttgcgcccgaacttgtcggaagcgatgcccaaaggcagttgcagcagagcctgtgtcagcccgtaaatgcccattgccagcccgaccagcgttttgttgccttccgcgccgggcagcgaggcggcatacaccgccaatacgggcagcacgaggaacatacccagcatacgcagcgcgtacacgccggaaagcgtcgtactggcgcgccattcgtgcggaaacatttggatgcggttgtctcttgccatcatattttttcagacggcatcaacagttgcaatgccgtctgaacttccagtgaacagattttcggattatacaggattcgccgtatttcggttgcggcgcgggttcaaaatcaacgccactgccagcggttgcgccacgcgcccaaaacggcgttcggatatttattgctgcccaagctgccgttaaagcgggcaagcgcgcggacgatgttgcctttttcaagattccggtaatggcgcaggatggtacagccgtaacgcaggttggtgcggatgtcgaacaggttgtgcgccggtttgccgatgtagtttttccaaaacggcataacctgcatcaggccgcgcgcgccgacaccgctgattgcatactggcggaacgcgctttccacctcaatcagccccaacacaatctgcgtatccaaaccggcccggctgctttcgtactggatattgaccagcagcctgcgccgctcctcctcctcggggacgaaccttgccaaacgtgccgacatggcagacaaccaacgctcgccctctttcggattgtcaaacaccagcctcggcggattgacgctgccgacagaactcctcatcacggaagccacatcgtcggcaagcgtttcctcacgttgcgcgccggcgtgcgccagaggactgagcaacaacgcaccggcggcacacaacaggcggcggcgttgcagattaacgggtagggtatcggtcggttttctcatagggaacgggggcgcgtccggacgtttcagacggcattaaatattcaaacagacataattgctttcaacgcgaaaaaccgcgcgcaaaatccaagcgcggcatatcgccctgcccttttcgggcaaacctcaattctaccgccctcaagaacgcttgtccaaacaggcacaggcaacaccgcccgggcatttccgttttcaccggttatccgtcgtccggattatgcagcagcaccatcagcgcatcacgcttttcgggcggcagcaggcggaaatatagtagattaaatttaaaccagtacagcgttgcctcgccttgccgtactgatttaaatttaatccactatatcttgaggcctttgcaaaattcctttccctcccgacagccgaaacccaaacacaggttttcggctgttttcgccccagatacctcctaattttacccaaatacccctttaatcctgcccggacacctgataatcaggcatccggggcaccttttaggcggcagcgggcgcacttagcctgttggcggctttcaaaaggttcaaacacatcgccttcagatggctttgcgcactcactttaatcagtccgaaataggctgcccgggcgtagcggaatttacggtgcagcgtaccgaagctctgttcgaccacatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttaaatttaatccactataacgggttttcgacaaatatcggttgcgtttggtttgcgcctccgtcagcggacggttgcggcaggctttgcgcataatgccgttctgcaaccgatgctctttcagttttccgtaggtcggattctcgaatccgacattacttcaatcgtatccaatagaaaagtccgcattgccgccaccccaattatgcggataaataccctgtttgacataacggtgaaacgtagaaaacccccaatcggaaatttgtcctacatagccatgtttgaccggattgaaatgcagataatcaaaatgccaggcaaaatcggcctcatcgcggatagtatattcccaaaagcgtttttgccaaagcctgagattgccgccgattaaatattggctgtgccgcttgatttgccgccagcgttccgaataagcagaatcattgtccggcagccgccatatggtatgcagatggtcgggcatcaacacccatgccaaaatttcaaacggataccgttcgcgcaccgccattaccgcctgccgtaaagccaaacgcaccgcatcatcggtcaaaatcttctgccgtttattggttacaaccgtaaaaaagtaagtgccgccattgcggtaaaaacgacggtatttcatagtattatgctcggaatgattttgtaggtcggattcttgaattcgacattttgggcattgctgcaatggattgcaatgatgggaatgttaaaggttttgtcggatacaagtatccgacctacgcttgctgaaccgtcattcccacgaaagtgggaatctagaatctcggggtttcagtcatttccgatagattcccgccgcgtcagggggtctggattcccgcctgcgcgggaatgacgggtttcaagattgcagtgttgtcgggaatgacgggtttcaagattgcggtgttgtcgggaatgacgaatccatccatacggaaacctgcaccacgtcattcccacggaagtgggaatctagaatcccggggtttcagtcatttccgatagattcccgccgcgtcgggggtctagattcccgcctgcgcgggaatgacgggtttcgagattgcggtgttgtcggaacgcaactgaaccgtcattcccacgacagtgggaatctagaatctcgggggttcagtcatttccgatagattcccgccgcgtcagggggtctagattcccgcctgcgcgggaatgatgggtttcaagattgcggtattgtcgggaatgacgaatccatccatacggaaacctgcaccacgtcattcccacgaaagtgggaatctagaatcccggggtttcagtcatttccgatagattcccgccgcgtcagggagtctggattcccgcctgcgcgggaatgacgaatttcgagattgcggtattatcgggaatgacgaatttcgagattgcggtattgtcgggaatggcgggtttcaagattacggtgttgtcgggaatgacggttcgggtatttccacgcccgccccgcgcctgtaaacggcaggtgaatcaaaaatgccgtctgaaggttcagacggcatcggtgtcggggaatcagaagtggtagcgcatgcccaatgagacttcgtgggttttgaagcgggtgttttccaagcgtccccagttgtggtaacggtatccggtgtctaaagtcagcttgggtgtgatgtcgaaaccgacaccggcgatgacaccaagacctaagctgctgatactgttgctttcgtgataggcaggtttgttggtcggaccttgtacgattttgcctggcactgtagcgccttgcgctggtggactgaaagtagtcgtggtttcttttctcaccgaatgaacctgatgtttaacgtgtccgtaggcgacgcgcgcaccgatatagggtttgaatttatcgaatttatcgttgagtttgaaatcgtaaatggcggataagccgagagaagaagcggcgtggaatgtaccgttttcctgattttccgtcttcagttcttgccagatgccactgctattgtttttttgcaactcttttgtgtttacggaatatttattgttgttccattttctgtaactggcataatctgccgctatcctccagccgccgaaatcgtagccgaccgacacccgggggtggatggaatgcgcacggatgtttctgaaataatcgcttactgtgcttgtgttgtttgcaccggttgctttcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaaggttttttgggggctggattcattttcggctccgtattcggttttaactgattaaaaagaaagattttcaatgatgttgcaggagcggactatatcaggtttgtggcgatgtttcaacacaatatagcggatgaacaaaaaagagaacgattctctaaggtgctgaagcaccaagtgaatcggttccgtactatttgtactgtctgcggcttcgttgccttgtcctgatttttgttaatccgctataaacaacgcttcgtccgaaaaaacgattgaatttgcgggcagaagctggacgaaaaccgccgacagcctgccgcaaaaggcacacggtttgcgctagggcttaggcgtgtcgcgcgaaatcaatgcgggcaggcatcatttcctctacggcggcatcagcggcggcggcgtgcattattgggataacaaagatttcagcgaacagagcctgcgcctgtcgttcggctataaaaaccgttcggtaacgcgctcgttcggcatcgtgccgtttgtcgagcaaaacctcttaggcggcagccgatacaatttcgtcggcggcttcaatgccgatttctcccaacgcttgagcgaacgctggcggttgacactaaacgcgggcaatatgtggaagcattatcaggaagaccgcaccgccgcccgatacgacagccatatgccgctggcgggcgcgacgctgatgtattccgcgccgaaagactggctgctttacggcggtgcggactggtcgcacaacataacgaaagaggcggaacaggcttccatccgcaagggtttgcgtgtcggcgcggtcaaaacgttcgacggcggcttgggtctgcgggcaaacctgcgctatacccgcaggatgtttgacgcacccgggaccattgtgtaccgcttcccgcgcaaagaccacgaatatcaggcaaacctgtcgttgtggcatgacaaaatctcttggaagggctttacgccgcaactcaatttccgctatctgaaaatcgacagcaatatgaaaagtttttacacacgcaaaaacatgcagattttcatgagcgtggaaaaggatttcaaataagcgcaaaaaatgccgtcggcaacatccgtgggcagaatcaaaaaccgccgcatcatttattgtcaacgcctgcgccgtcagagtaacattgcgtttttcccccaccggtatccgccatgaccaccacccccgcaaacgtcctcgcctccgtcgatttgggttccaacagtttccgcctccagatttgcgaaaacaacaacggacaattaaaagtcatcgattcgttcaaacagatggtgcgcttcgccgccggactggacgaacagaaaaatctgagtgccgcttcccaagaacaggctttggactgtctggcaaaattcggcgaacgcctgcgcggcttccgccctgaacaggtacgcgccgtggcaaccaacacattccgcgttgccaaaaacatcgcagatttccttcccaaagccgaagcggcattgggtttccccatcgaaatcatcgccgggcgcgaagaggcgcggctgatttataccggcgtgatccacaccctccccccgggcggcggcaaaatgctggttatcgacatcggcggcggttcgacagaatttgtcatcggctcgacgctgaatcccgacattaccgaaagcctgcccttgggctgcgtaacctacagcctgcgcttcttccaaaacaaaatcaccgccaaagacttccaatctgccatttccgccgcccgcaacgaaatccagcgtatcagcaaaaatatgaggcgcgaaggttgggatttcgccgtcggcacatcgggttcggcaaaatccatccgcgacgtgcttgccgccgaaatgccccaagaggcggacattacctacaaaggcatgcgcgccctcgccgaacgcatcatcgaagccggttcggtcaaaaaagccaaatttgaaaacctgaaaccggaacgcatcgaagtttttgccggcggacttgccgtgatgatggcggcgtttgaggaaatgaaactcgacaggatgaccgtaaccgaagccgccctgcgcgacggcgtgttttacgatttgatcgggcgcggtttaaacgaagatatgcgcggacaaacggttgccgagttccaacaccgctaccacgtcagcctcaatcaggcgaaacgcaccgccgagaccgcgcaaacctttatggacagcctctgccacgctaaaaacgttacagttcaagagcttgccttgtggcaacagtatctcggacgcgccgccgcgctgcacgaaatcggtttggacatcgcccacaccggctatcacaagcattccgcctacatcctcgaaaacgccgatatgccgggtttctcacgcaaagaacagaccatacttgcccaactggtcatcggtcatcgcggcgatatgaaaaaaatgagcggcatcatcggcaccaacgaaatgttgtggtatgccgttttgtccctgcgccttgccgcactgttctgccgttcgcgccaagacctgtctttcccgaaaaatatgcagttgcgcacggatacggaaagctgcggcttcatcctgcgtattgacagggaatggctggaacgccatcccctgattgccgacgcattggaatatgaaagcgtccaatggcaaaaaatcaatatgccgttcaaagtcgaggccgtctgaaccttgcggaacaaatgccgtccaaaccctgtccagacggcatttgcctgtccgcaacatcccgatatgcgcggcacatctgctcggaacggtcatgcaggcgtaaaaaacaaggggcacataacccaaaaaccgcctgaaaatcttcaggcggtttcgtttgggttgccggcaggcggcatcccatcatttttgccaaggcaacaaattatttggcggcatctttcattttgtctgccgcttcctgagtcgcgtcggcagctttgttcaaagtatctttagctgcttcagttacagcttctttggcttcagttacagcttcctcggcacttgcctttgcatcagccgcagcatctttgacttggtctttcgcttcttcgacggcagaagcggcagactcggcggcagaagccgcagtgtctttaacatcggactcaacggcttgaaccgcttccttaacctcctgtttggcttcttgcgaacaagctgccaaggcagccgccatcattgcggcaatcaataattttttcatgtcttatccttcttgagttgttgattaaggttttgcttaaaaatcggaccgtgttccatcaatcggctgattttgcccatcgaccggagagaaaacggtttcccgtttagttaaaacccattatatttaaatataaaggtttttttctcgaacaataaggcggcatcaatgccatattgaaacacgtccgaaaactattttatgaaaacagttcggaaaattgtaacacatatccccctccttttgagtttcccgacggtgcggactttttcctgcagggtttgaaaaacccaaatatattccgggatgtccgaatacctcaataatggcggcggcggaaataaaacgccccttcgctgtcgatttccagcacatagcgtccgttctgcacggcggcatagccgcttttgcctgcctgatagggttgcagggcggcatgcgaaactaggtaatccgtcagtttgccgccgtcttcggcgatattgcccaccagtttggcaaacaaggtatggcacacgccgttttctgcccaacctgccggactgtccttatcatcggtttccatacatttgccgctgacggcttccaagtcgccgggatgcttgccgatcagtcggataacattttgttccggcaagcctttaatcggataactgatttgttttttgccgtcgttggttttgccttcgctgctttgtcccaaatccaaaccggcaatcgccgtattgtcgatatatttgactttgaaaaccggtttcggcgcgctttgtaccgcgttttgcggctgttccgccgtattttcggatttgccgcaggcggcaagcagcaggcagccgcccaatacggcaaaagatgttttcagcattccacactcctgatggtttcaaaatgccgtctgaaacgcggcaggcggaggttcggacggcatcgggttcatttcaacgggcggatgccgaccgcatcgcgtactttgtccaataattcgcgtgcttctttacgcgctttcgccgcgcctgcctgcaaaatctcttcgatttgcgaagggtcggcggtcagctcgttgtagcgttcgcgcggttcggcgagttcggcgttgattttcgccgccaaaagttttttggcttcaccccacgccaagccgtcggcaagcattttcgtaaattccaccgtttcagacggcgtggagaaggctttgtagatttcaaacaatgggctttcgtcgggctgtttcggctcgcccggctctttcatattggtgatgattttgttgaccgatttttgggtttttttgtcgttttcccaaagcggaatggtgttgccgtaggatttggacattttgcgtccgtccaaaccgaccaagagttcgacgttttcatcgattttcacttcgggcagggtgaagagttcccggaagcggtggttgaagcggccggcgatgtcgcgcgccatttcgacgtgttggatttggtcgcgcccgacgggcacttcgttggcgttgaacatcagaatatcggcagtcatcagaatcggataactgaacaaacccatttccacaccgaaatcagggtcttcctgcccgttttctgcatttgcctgcacggcggctttgtaggcatgggcgcggttcatcaaacccttggcagtgatgcaggtcagaatccagttcaattccatcacttcgggagtgtcgctttggcggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcgaggttttgcgccgcgcggacggcggggcggatggcgccgacgtagttgcccagatgcgggatgccggtggtggttacgccggtcagaactcgttttttgctcataaaaatgtccttgcggcatcaatgccgtctgaaagggaaaaagatgtgccgattatacccgatttgccacctacatccagccgacaacagacttttccatattaagaagatatagttatacacattattatacatttttatatactttaaattcaatgatatatcgaattaaatatagaaaaacagaaaacagaacttgagttatccacaattatgcacatataggcttcgacagcggacattttgaaaaggaaacaaaaatgcgatacgacaaattaaccgccaaattccaacaagcccttgcagaagctcagagtttggcgttggctgcggacggcagctatctggaagcgggctttgtgttaaaagccctgcttgacgaccaaaacagcggagccgccgcgctcttggctcatgcgggcgtgaacgtgccgcaggtgaaacagcgtttgcagcagcatttaaacagcctgccgaaagtgtccggtcagggcggcgatattctgcccagccgagaattgcaggcggtgttgaacctgatggacaaagctgccaccaaacgcagcgatgcctatattgccagcgaacttttcctgcttgccttggtacagcagaacgatgcgaccggcaaaattttgaaagaagccggcgcgaccgaacaaaacatcaatgccgcgattgacgcagtacgaggaggacaaaacgtgaacgatgccaatgccgaagaccaacgcgatgctttgaaaaaatatacgcttgacctgacccagcgcgcccgcgacggcaaacttgaccccgttatcggtcgtgacgacgaaatccgccgcgcgattcaggtattgcaacgccgtaccaaaaacaaccctgtgctgattggtgagccgggtgtgggtaaaaccgccattgttgaaggcttggcgcaacgtatcgtcaacggcgaagtacctgaatccctgcgtaacaaacgcttgctggttttggatttggcggctttgattgccggcgcgaaataccgcggcgaatttgaagaacgcttgaaaggcgtgttgaacgatttggcgaaagacgacggcaacactctgattttcattgatgaaatccatactttggtcggcgcgggcaaaaccgacggcgcgatggacgcgggcaatatgctgaaaccggctttggcacgtggcgaattgcactgtatcggcgcgaccactttggacgaataccgccaatacatcgaaaaagatgcggcactcgaacgccgcttccaaaaagtattggttggcgagccaagcgtggaagacaccatcgctattttgcgcggtttacaggagcgttatgaaatccaccatggtatcgatattaccgaccctgctatcgttgccgcagcggagttgagcgaccgctacattaccgaccgcttcctgcccgataaagcgattgatttgattgacgaagccgccagccgtgtcaagatggaaaaagaaaccaagccggaagcaatggacaaaatcgaccgccgtctaattcagcttcggatggaaaaggcgcacgttgaaaaagaaaaagacgatgccagcaaaaaacgtttggaactgatagacgaggaaatcaacggtctgcaaaaagaatacgccgatttagacgaaatctggaaagccgaaaaagcaatttcagacggtgctgctaatattaagaaacaaattgacgaagtcaaaattaaaatcgaacaggcaaaacggcaaggcgatttggcactggcttcaaaattgatgtatgaagatttggagcatttggaaaaacagcgtgcagccgccgaacgggcagatacggacagcacaaaaccggcaaacaaactcttgcgtaataatgtcggcgcagaggaaatcgcagaggtggtttcccgtatgaccggcattcccgtatccaaaatgatggaaggcgaacgcgacaaactgctgaaaatggaagaagtattgcaccgccgcgtggtcggacaggacgaagccgtgcgtgccgtgtccgacgctatccgccgcagccgctccggtcttgccgatccgaacaagccttacggcagcttcctgttcttgggcccgaccggcgtgggtaaaaccgagttgtgtaaagccctggcaggctttctgttcgacagcgaagatcatctgattcgcatcgatatgtccgaatatatggaaaaacacgccgttgcccgcttaatcggcgcgcctccgggctatgtcggctacgaagaaggcggctacctgaccgaacaagtgcgccgcaaaccgtacagcgtgattctgctggacgaagtggaaaaagcccatcccgatgtgttcaacatcctgctgcaagtattggatgacggccgcttgaccgacggacaaggtcgcaccgtggacttcaaaaataccgttatcgtgatgacttccaatattggtagccaacatatccaacaaatgggcattcaggattacgaagcggtgaaagaagttgtgatggaggatgtgaaagaacatttccgccccgaaatgatcaaccgcatcgacgaagtggtcgtgttccacggactggatcaggataatatccgcaacattgcgaaaatccagctcaaaggcttggaaaaacgtttggaaaaacaaaacctgcgcctggctgtttccgatgccgcactggacatcatcgccaaagccggtttcgacccgatttacggcgcacgtccgctcaaacgcgccatccagtcggaaatcgaaaacccgctggcaaaagccctgcttgccggaaactatgcgcccgaaagcgaaatcagggtggaagccgacggcgacagactgaaatttgcctgattcgttcctgctgttgaaaatgccgtctgaaacgggaatctccgtttcagacggcattttttatcctcggcagacaaaccgtccccttattggcggtaggtttgcaggaatcttgccagcctgcccatcgcctcttcaatctgatggacgtaaggcagcgtaacaatgcggaaatggtcgggcttgatccaattaaaccccgttccctgcaccagcaagactttttcgcgcaccagcaaatcgtaaacgaatttcatgtcatcgcggatacggtacatttcggtatcgatttttgggaacatatacatcgcgcccatcggtttgacgcaggatacgccgggaatctggttgaccagttcccacgccctgttgcgctgttccaaaagccgtccgccgggcaaaatgaattcgttgatgctctgatagccgcccaatgccgtctgaatcgcgtgctgcatcggcgtattggcacacaggcgcatagacgagagcatatccaaaccctcgatgtaaccttttgcatgatgtttcggcccgttgagcaccatccagccttggcggaatccggctacacggtaggctttggacaaaccgttgaacgttaccgtcaaaaggtcgggggcaagcgcggcgatgtggtggtgaaccgcgccgtcataaaggattttgtcgtaaatctcgtcggcgaaaataatcaaaccgtgcttgcgcgccagttcggcgatttccaacaggatttccctgctgtacaccgcgcctgtcggattattgggattgatgacgacgatggctttggttttgggcgtgattttggcttccatatcggcaaggttggggaaccagccgttttcttcgtcgcacagataatggcgtaccgtaccgcccgcaagcgttgccgccgccgtccacaagggatagtcgggcgcgggaatcaggatttcgtcgccgtcgttgagcaatgcctgcatagacatcgtaatcagctcggacacgccgttgccgatatagacatcatcaaccgtaatatcgcgcaaacctttggtctgatagtagtgaacaatggctttgcgggcggaatacagccctttagaatcgcaatagccttgcgaagtcggcaggttgcggatgacatcgaccaagatttcatcaggggcttcaaagccgaacggcgcagggttgccgatattgagtttaaggattttattgccctcctcttccaactgaagggcttttttgtgaaccggcccgcgtatgtcgtaacagacgtgatcgagctttgcagacttgggaaatttatccatgatgtgttccgtaaattttgggcaatgggtgggaatgtactctttttcacgcggaatttaaagcatcaaaccgagattttcaggctttttacctgccctctttgcgccgttcgctgacgcttttgccgcctattccccagttatcggtatccacttcgtcaatcacgacaaccgttgtttcgggatttttgcccagcacgcgtgccagcaattcggttacgccgccgatcagttccgctttttgcgcggcagtcggtgcttccttgccgccggttactttaatattgacataaggcatgatctttctccgttttaaaatattgctatcttatcaaacaagttgcctccgcccaaacgtccgcttcattttctgaaaaattcaaatcgatatagtggattaacaaaaatcaggacaaggcgacgaagccgcagacagtacagatagtacggaaccgattcacttggtgcttcagcaccttagagagtcgttctctttgagctaaggcgaggcaacgccgtactggtttttgttaatccactatacaaaaagacagttttcagacagcaaatccgtcttcacacgatacctattttgttataacataacaaaatctttaacccacacgagacaaaggctgcaccatgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaatcccgcccgcacaaaaatgccgtctgaaggcttcagacggcattttttgttcaaacatcaataccaaccgcgcagtttcatcgctttttcaacacggcggatactcatcatgtaagacgcggttcgcaaatcgacatcatactcttgcgccaagttccatatatcgcggaacgcgcgtcgcaggacgacggtttctttctcttgaacttcgtcaaactcccaataatagccttgcaggttttgcacccactcgaaataggaaacgaccacgccgccgcagttcgccagaatatcaggcacgaccaatacgccgttttgacgcaggatcacgtcggcttcgggcgtagtcgggccgttcgcgccttcgactacgattttcgcgcggactttaccggcgttttcggaagtcagttggttttccagcgcgcaaggggcgagtacgtccacatccaaagccaaaagttcggcgttggtaatttctttgccgtaaccggcttcgttggtgatgaagcctttttcttggaactctttaaacaaagcttccatatccaaaccgttttcgttgtaaatggcaacgtcaacagtagaaaccgcaacaactttcgcgccggattgatgcgcgtaataacctgtgtggtaacccacattaccgaaaccttgaatggcgtaagtggcacccttcacgtccttgcccagtttttccaaagcttggacggcggcgaggttcacgccgtaaccggtagcctcggtacgcgccaaagagccgccgaactcaaccggttttccggtaaatacgcccggcgcggaatgtttcaccacgttttcataagcatccaccatccacgacataattttgccgttggtattcacatcgggggcgggaatatcgattttctcgccaatcagcggggcaatcgcttcagcataagcgcgggcgatgcgttccagttccgcctcggaataatcgcgcggatccaaggtaatgccgcctttgccgccgccgtaaggaatacccgcaacgcagcatttgatggtcatccaaattgacagggctttgacttcgtccaaattcacactgggatggaagcgcacgccgcctttataggggccgacggcgttgttgtgttgcgaacggtagcccgtgaaggttttgaccgtgtcgtcgtcgagtttgacgggaaaattgacttccaacacgcgggtcggactcttcaggatttcataaacggccggatcggttttcagccggtcacaggcggttttcacctgtttgcgcgcgatttcaaacggattgagggtttcttttgcaagggcttcagacattttgcttccttttcacaaagagaggttcggaatggaacaagccatcaggttcgcaactataaccaattttcaagcaaaatgtaatagcgtgtagttggaatcggcccgatttgattaatctatatatgattttatttcccaagccgcacggaatccgtctgaaaaaagcggaacacatatccaaaaagcaaatgtccaattaaataaagatataagaatccttttattttttaaaaatttaattggaacggcgccgggatttgcacacccttcccgactccgttccgaaatccggaaacaccgccggcaaaacctgtttcgattgttaacaatccatacattagaagccctgtgcaaacgatgttaaaataaaccttttcaacccgacagaaaaccggattatgaatgcagccatcgaacacgtccaagccgtcgccttcgatttggacggcacactgtgcgattccgtccccgaccttgccgccgccgcagaagcgatgttggaacaactcggtatgaaaccgctgcctgccaaagtggtcgaaagctatgtgggcgacggcatcggcaaactggttcaccgcgtcctcaccaacgaccgcgaccgcgaagccgattccgaactgtgggaaaaaggtttcgtatctatatgaaatactaccgcgaccatttgagcgtcttcacccgcccctatcccgaaaccgaagccgggctggcattgcttaaatctttgggcatcccgctcgccgtcgttaccaacaaaaacgaaatccttgcctccgagcttctaaaacaactgggactcgccgactattttagcctgatactcggcggcgacagcctgcccgagaaaaaacccagccccctgccgctgcggcacgccgccgaagttttgggtatcgatgttgcaaacatggttatggtcggcgactcgcgcaacgacatcatcgccgccaaagccgccggctgcctgagcgtcggcgttaccttcggttacggcgatatgacgctgctctcgcaagacgatgcgacccgccccgactggattatcggctcgctgcccgaaatttacgaaaacctgcaacctcagaaaaacaaagaagagtaggcattcggacggctccggtttgcgccgctatgccgtctgaaacctgccccacgccgaaaccgccgccatgaaaccgcaaaaatccctacgcgcccgcgcgatggacatcctctcgcgccaagaactcagccgcatcggtctgaaacgcaaacttgcaccgcacgccgaaagcgaagaggagttggaaaacgtgttaaacgaatttgccgaacgcaactggcagtcggatttgcgctatgccgaagcctatatccgcagcaaaagccgcaaacacggttcattgaggctgaaacaggctttggcgcaacagggcatagatgaagaaaccagccgcaacctgcttcccgaccgctcaagcgaaaaactggccgccatagccgtgttgcgtaaaaaattcaaacatccggccgccgaccttaaagaaaaacaaaaacaggcacgcttcctcgcctatcgcggttttgatgccgataccgttcagacggcattgaaacatgcctgggatgacggctgggaggaagactgctgaactgaatccttgaatctttttgcatgacggcgtaaccttacctccatttccaacttttccgattgagaataaaatgtccgaacaatccgagaaaaatcacaacccacttcttgaagatgaacgcaaaaacccggtttaccgtatgggtcaggcagttgccggattcatgctcgtcgtttgggcaggcgtattggcactcgtgtttttcctagtcttccgtttttggctttcctaaacaaaatgccgtctgaaaccttcagacggcatcggcagcccatttcggcaggctatcccatcatagctttttttagcttgaattccactttcccattccctaaaatttttccacacccatttcaaaataccctttcttaaaacaggtacactatgacacaacaacgccaactgccttcgcacgaactcattatgtccgaactgatgatgccggacaccgccaatttcagcggcaacgtacacggcggcgaactcctgctcctgctcgaccaagtcgcctattcctgcgccagccgttacagcggcaattattgcgttaccctgtcggttgacaaagtcctgtttaaagaacccatccatgtcggcgacctggttactttctacgccagcgtaaactacacggggcgtacctctatggaaatcggcatccgtgtcgaagcacaaaacatccgtacgggagaaatccgccataccaacagctgctacttcaccatggttgcagtcaaagacggcaaacccgtccctgtccctccgctggaaatcctgaccgaccgccaacgctgccgctacgaaaaagccaaaaaacgcagagacatcagcctgcaagcctccggagacgtgtcctgcggctgctgacggcggactatgccgtctgaaagacaggcacatcgcgccatccgtttccattgcaaacggatgaaatcaagcaaatatagtggattaaattcaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatacccaaacacagtcaaacaaatttatatgccccatcccttccgaataatttgaaaacacagccgccaaaaacaaaaatgccgtctgaaaacctttcagacggcatttccaacttgatttcaggcagaaagtcagaacgcgatatagctgttcgggttaaccggtttgccgttttgacgcacctcgaaatgaagctgcgttctggaagcatcggtattgcccatcaaagcaacctgctgaccgcgtttgacctgctgcccctcgccgaccagcaatttttggttgtgcccgtatgcggtcaggaaagaagaattatgctggatgatgaccaagtttccgtatcccctcaaacctgaaccggcataaaccactttgccgtcagccgccgccaaaacgggctgtcccgcattaccggcaatatcgacacccttgttgttgccgccgaaatcggcaaccactttaccttgcgtcggacgctgccaaacaatgccgccgaccgaacgcgtgccggaaggcgaagcggcaggagattgcggggcgggcgcgggaaccgctttattttccgcagcgggcgcggcaggttgcggcgcggactgcacaggcggttgcgcggcgggtttcacaggggtttgcacggcagccggtacggcgggcctgctttctacggctgcggttttcggtgcggcatatcctgccggtttgactttaacaatctgaccgatgctcaacatattgtcggtcatgccgttccacgcacggaaatcgtcttgagagatatggtagcgtttggaaatgttgtacaccgtgtcgccgcgcacaatagtatgcgtcgccgcgttaatgtcgacgggtgcggactgtacgggcggttgcgcggcagccggtacggcgggcctgctttttacggctgcggctttcggtgcggcatatcctgccggtttgactttaacaatctgaccgatgctcaacgtattgtcggtcatgccgttccacgcacggaaatcgtcttgagagatatggtagcgtttggaaatgttgtacaccgtgtcgccgcgcacaatagtatgcgtcgccgcgttgatgtcgacgggtgcgtaagaaggaacgtatgtacccgaaacggcaggtgcagacggcggaacataagcaggaggcgtataaaccggcgcgctttgcaccggcggcacataaggcgcatcgccggcaggagccgggctgtacggcgttgctccataggggttgttgtaaactgccgaagacggcgcgtcctgcatacctgaattgcctgcaatgacaggagcaggctgttgggtggcgcaaccgcccaacagagcggcaacggcggtacaagctgccaaaagtgtcgtttgtttcaacataagataaccttcatgttccgatatatagcctgaatgcggtatatcataataaaaatgcgcgttcttctcaagcgcaaagcccgacggtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatttgatgaaacggtcagtccgcatgccagaacgccgctgtttccgccatgtccggataggcggtcaggtcgatttgcagcggcgttacggtaatgaaacctgcgccgcattcaccgaaatccgttccctcttcccgatcggaaacttcgccgaccggtcctatccaataaatctgttcgccgcgcggattgcgcgcgggaatgacgttctgaccgtgatgcctcctgcccaaacgggcgattttaatgccccgcacatcttccggcgcaacggcggggatattgatgttccacaaaataggggactgcggggggtttttgaaaaaatgcgccaacaatgtccacagtgcctgttctgcggtcgcccaatagcgtccggaagcgtcgtttaaggaaaacgccacggcgggtatgcccataaggtaggcttcggttgccgccgcaaccgtccccgaataaagcgtgtcgtcccccatattcgcgccccggttgatgcccgaaaagacaaaatcggcctgaaaatccgaaaatacagactgcccgatgtggatgcagtcggtcggcgtgccgttgacatagtagaacccgttttgcgcctgtttcaactgcaaagggcgttccagcgtcagcgaattgctgaccccgctcctgtcgcgttcgggcgcgaccaccctgacgttggcaaattccgccgtaacgcgcgccaaaacggcaatgccttcggagaggtagccgtcgtcgttggaaatcaaaacgttcattttctatcctgaatgcttattcttcgggcaatttggtgattttgacccgctcgatgcgctgcccttctttttcgaccacttcaaaccgccagccgtggaaatcggcaaaatcgccgacatcggggatggtttgcaattcttccataatcagcccggcaaccgtatggaaatcggcatcttcctcctgctgcggcaggttgagttgcggtgcgagttccacatattccaacgcgccttccaccgtcaggctttcatcgggattcccctgaacggctggttcttcttcgcgctcaaattcttcggggaactcgcctgcgatggtttcgagcaggtctttcatggttaccatgcccaataccgcgccgaactcgtccaccaccaaagcataatccgcgctgctttggcggaagagttcgattgcgcccagcgcggtggtgctgtcgggcaggacgagcggctggcgcaatgccgtctgaatgtcgagaccgcctgtttccagcagttgggacagcaggtcttttttgttgatgtagcccaaaggttcgtccacgcccgccttaccgacaacgagcaggcggctgtaaggcgtgttttgcagttgggcacactgttcttcgcggctttgggaaatgtccagccgttcgatgtcgcggcgtgggatcatcacccccataatcgggcgttcggcaagcgtcagcacgctgcgtatcatcgatttttcgttttcttcaaaatgcgcgtcgtccccggattcgccgcccgcgtcggcaagcacgctttcgcgtatacccatcatacccaagacgttttcggcggtgcgcttgcgccacgagctgccgatgtagtcgtttttgcggctgttgcgctgcgaaatctggttaaacaattcgattaaaatcgagaagccgatggcggcgtagaggtagcctttgggaatgtggaaatggaaggcttcggcaatcaggctgaaaccgatcatcaacaaaaaaccaaggcagagcatcacgacggtagggtgtctgtcgacaaattcggtcaagagtttgctggcagaaatcattacagccatcgcgacgacgaccgcacccatcgccacgacgatatgatcgaccatcgccaccgcagtaatgaccgaatcgatggaaaacacggcatccagtatcaggatttgcgcgaccacgccccaaaacggcgcgtgttttttttggctgtcggcaacggtaaaacggttgtgcccttcgaggcgttcatgcagttcggtggtggctttgtaaagcaggaaaataccgcccgcgagcataatcatgtccttgccggaaacggcgaggccgccgatttggaacagcggctcggtcagcgtgatgatgtgcgccataaaagcaagcataatgatgcggatgacgactgccagccccagcccgataatccgtgcgcggtcgcgccgtgcgggctggaccttgtttgccaaaatcgccacaaagacaagattgtctatccccaatacgacttccaacaccaaaagcgtggcaaaacctatccaggtatgcggttctgccaaccaactgaaatccatgattttcgtattcctcaagttcaaacgcgaaaaggcagcctgaagcgctcaagctgcctgaacagacggtacgcacaaaaaacggcgggcgggcttgctgctctgctcggggtcttgcatgtgcgtgtaccttcggtcgaaataatttaaatagtttaacagcttatcggggcaatggcaaaacgccataccgtctgaaaggatgttcggacggcatgagcttattttgaaatgtttcaacacacggacggcacataaagccttcccctatgtgttgccctgattgaggggttgcgcccctctcaaatacagtctgattctaccgccgcgaagaacggatgttcgagtgcggacggagtcccaacgcttaaggggtgatgatgaagccgtctatcggcgcgtagcctttggtgttgccctctttatcggtaatgactatccactctttctgcctgctgctggtaaacggcaggtaatacagctcctccccttcggcgagacctgcctgtttcagaatgtccgcaaccgtcgtttttctcgcatccgccaagactttcagcggtttcagatgtttgcggatttcttctgcttccttgtcggaatacggcagccactggtcgggacgcatactcggctcgatacctttcagggacaaatccagcgtcttgttcttctcatccgcatcctcaggttctttcaatgcaatgcggcggatgccgaaccacgacaggctttgcagcccttcgggggctttgtgcaaatcttcgaccacgacttccgccgccgtaacaatggtcatacgatcctgttcaaacgcttccaccacaggacgcgccagcgaaacgctgtgcagaccgtacaccaaagccgccagctggatgatgccgaccatggaaaaatcgaccatgcgtgcctttgtctttttcttcgggcttgccaaaattaaagtcagcagcggaccacatacaatatcgacagccaccaccagctgataaagcgacagccctcccgtcagctcggcataaggataaggataccaaaccttaaaaaccagcaatgccgccagccctgcaaccgacaggctgattaagaggtgccagcccgcacttttcaaggcaaaacgccatctcgggactgtttttccgttttccatcatatcttgttcaaatcaaaaataaccgtaaaaacagggcgcattgtacaacagatagagactgcttaaaatgcggcgccgtctgaaatcctgccgttcagacggcatccgtcacccgacatccatacacagatatttcaattctagatattcgtccgcaccgtatttgctgccttcacgtcccaaaccgctacgtttcacgccgccgaacggtgccgcttcattgctgattaagcccgtattgatgccgaccataccgtattccaaggcttcgccgacgcgccattggcgggcggtgtcggcggtgaaaaggtaagctgccaaaccgtattccgtattgttcgcagcctcgatgacctcggcttcggtttcaaaacggaataccggacacaacggcccgaaggtttcttcgcgtgccaccgccatttgcgccgttacgccgcttaaaacagtcggttcgaaaaacgttccgcccaacgcgctgcgtttgccgccggtcaggcagcttgcacctttagcaagcgcgtcggcgatgtgctgctcgactttctccaccgctttttcctcaatcagcggcccttggttcacaccatcctccaagccgttgcccaatttgagcgcggctgctttttcactcaatttgcggcaaaattcgtcgtaaatggcggattgagcgtaaacgcggttggtgcagacgcaggtctgaccgctgttacggaacttgctggcgagcgcgccttcgacggctttgtccaaatcggcatcgtcaaacacgataaacggcgcgttgccgcccagctccaaactgagttttttaatgtccgccgcgctgtcggcaaaaatttttgcgccgacttcggtcgagccggtgaagctgattttgcggataatcgggttcgtagcaaattcatggccgatttccgaagcactgccgctgacaacaggcaacaaatcctgcggtatgcccgcttcgtaagccaacgaagccaaggcatacgcactcaaaggcgtgagcgatgcgggtttgacgatcatcgcgcaacccaccgccaaagcaggcgcggccttgcgcgcaatcatcgcggacggaaagttccacggcgtaatcgcagcggtaacgccgacgggctgtttcaacacgaccagtttttgcgacgctttcacactcgtcagcacatcgccgtcaatccgccgcgcctcttcggcaaaccagcgcacaaacgaagccgcataatcgatttcgccacgcgcctcggtcaggcttttgccctgctccatcgtcatcaggcgcgctaatgcttctttgttttctttaatctgaaaataccaacgccacaacacatcggcgcgttccaacgcagtttttgccgcccataatttttgtgctgcagctgctttttgaatcaggtttttcagcttgtccgaatccgtcttgcggacaaacgccaaagtctcgcccgttgccggattatcgactttgatgccgtctgaaaccgggggaagggaaatatcgggatgcttgattaattgggaatattcgttcatttcgtatcctccggtatgcggaataaccgctttcaaatgccgtcaatctcgcggacattatcatcttcatattccaaaactgcaaacccttccgatgccgtctgaagcatccgatcgggcagcgcaacatccgggcggtgtctgaatatggcgcgggcgcaatccctgtcgtttaagaaaaatattttttatacgatagtaatctttagaaagaaaagtaatgcagccctttgatggggtgcaatatataaggagcaaagattgcagttgcaacgtgtggtagagtatggcaaaaatccgaacattatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaaatccactatacagtcaaaattacggagatcaaataatgatttttaaacagaatcaaaattattgggcagtttttgatgctaataaagaaactctgattgttcaaacatgttcaggtttggggttaacggcaatagaccacctatatcccccccatatcctgccattggataccgacaatgaaactttaggcacgacagtcttgcaagcgttggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtggatatttggctgcacaacggctgcctgaaaatcagcccgagccgccatgtcaagctggaagcgtggaatgccattgatgcagacgatgtcattttatcattggataacagccctgaagaaatcggagcaggtttaaagttggcattgagccactgccgataatatttgacaaaaggccgtctgaaaaacagctttgacaaagacgcggttgccaaagagatcgacctacaaagggaagtaacgcaggcgttcggcaaaacgccgcccaagccgcagcggccgttgccgacgaactcggcaatacccgaagttacggacggtatcaggcagcccgaaccctgccggaggccgaactgcaaaacaaatccgacacaaaaaaccgtccgtccgacacaaaaaaccgcccgaaaaatctggacggcggttcaaacaggctgccccgtttaacgggcgcggcaggaagtttcgaccgaattgccgtaggcatcggtaaagccgaaaaaggcttcgccgcctttctggtgccactcggttgcgtttccgaacaaaccgtgttcggcggtatagcgttcgccggatgcggcaacgtcggaagagaggacggcacgcctgccgtccagccgcaacgcgactttgccgctgtccaaatggcggacgcgcacagacaaaccgttctcgcaggaaaacgcccgaaaatcgtccgtgccggcttggttttgaacgggcggcatatgcccgcgtccgccgtcatcatacgcctccggcacggcacaggccgccaaagacaaaaccggtacggtcagcgcgaaaaacctgatattcataaaagctccccaataaaaataagatatgaaacaaccgccctgattccaagctgcggcaacgccatactataaacggacgcgcaaacacacaagcccgataaccggaatttacctgcgatgaatcaataatccggattgcgcgccccttctttacccctcttccgatgccgccttttgcctgacgatgccgtctgaacctgcctgcccgcccggaggaatgtaaattttttccaaattccaagtaaaaaccgctatcggtgtgctaatttgcgttaaaatcctattcggcgtttaacgttttgtgcgcccgcatccctgcactgtttgatgcgggcataaggcacaaatcccgacaagcgcactgtttcatacttcgtcaatcattcagactccggtttgtgcccgtgccggcagatggttcggccgtttcccgccgttcaggcatattccgacagtgtgagataaggatttattcgatgaaatcactcaaaaccttcctcatttggggcatagtggtactggtcggcttagcatcctttaccactctggccctcagccgaggcgaacaggtcagcgcggtatggatggtcaccgccgccatatccgtttactgcatcgcctaccgtttttacagcctctacatcgccaaccgcgtaatgcggctcgatcctgaccgcctgactccggcagaacgccacaacgacggcttggactacgttccgacgcacaaaggcgtattgttcggacaccactttgccgcaattgccggcgcgggccctttggttggtccggttttggcggcgcaaatgggttatctgcccggtactttgtggattatcttcggcgtggtatttgccggcgcggtacaggatatgatggtcttgttcgtctctatgcgccgcgacggtaagtctttgggcgatattgtgaaacaggaactcggcactgtccccggcgtgattgcctccatcggtattttgatgattatggtcatcattatggcggtgttggcgttgattgtcgtaaaagcattggttcacagcccttggggtacgttcaccattgcagcaactatgccgattgcgctgtttatgggtatttacacgcgttatatccgtccgggcaaaatcggcgagatttccatcgtcggctttattttgctgatgctggcggtaatttacggcgaagatgtggctaaaagttccatcgggcattggttcgaccttgacggcatccagctcacttgggcgattatgatttacggctttgtcgcctccgtattgcccgtatggttgctgctcactccgcgcgactatctctccaccttcctgaaaatcggtacgattgcggccttggctttgggtatcgtcatcgtcaatcccgctttgcaaatgcctgccgtaacccactttatcgacggttcgggtccggtattctcaggcgcattgttcccattcttgttcattaccatcgcctgcggtgcggtttcgggcttccacgcgctgatttcttccggcactacgccgaaaatgctggaaaacgaaacccacgtccgcatgatcggttacggcggtatgttgatggaaagtttcgtagccattatggcacttgccgctgccgcatcgcttgatcccggcgtgtacttcgccatgaacagcccagccgccctgatcggtacggatgccaataccgccgccgaagtgattaccaccaagctgcaattccctgtcgatgccgcaaccctgttgcacactgctaaagaagtcggcgaaaacaccatcctttcccgtgccggcggtgcgcccaccctcgcagtcggtatggcgcacattatgagccgcctgattccgggcgaggcgatgatggcgttctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacacgggcgtgaccgacccgttgggcggcatcaactcgctctggcctttgttcggcatcgccaaccaaatgctggcaggcgtagccttgattatgtgcgccgtggtgctgattaagatgaaacgcgaccgttatgtctgggtggtactcgttcccgccgtcggcgtactgttcgtaacctgctacgccggcctgcaaaaactgttccacagcgacccgcgcatcagcttccttgcccacgccggcaaatacagcgacgcattggctaaaaacgaaatccttgcgcctgccaaagacatcggcgaaatggcgcaaatcatcttcaacgacaagattaatgccggtctgaccatcctcttcttgtcggttgtcgtgattgtcgccgcgtacggtttgcgtaccgccctcaaagcacgcaaagtcggctggccgaccgccaaagaaatcccggcggtgtaccgcgacggcaaacagccggaggcacaaagtgaagcataagctcgcgtcttggtggaaaaccatcaagctgacggcaaacttgatggcaggcgtgcccgattatgaaaactacgttgcacagcagcgcaaacataatcccaacgcccccgtgatgaccaagctgcagtttcaagactattgccgcaaacgccgctgcggcgcaaacggcggacgctgctgttaagcctgcttgaaacaaattccgtctgaacgccgcttcagacggaatttttataatatagtggattaacaaaaatcaggacaaggcgacgaagccgcagacagtacaaatagtacgaaaccgactcacttggtgcttcagcaccttagagaatcgttctctttgagctaaggcgagacaacgccgtactggtttttgttaatccgctataccacgatgaatccttcgcaatatctgtttatcgacctcaattttgacaaaataccggatacgcgcctttgttgcttttccatcttccaaccaactgtaaatctcaaacagccggtacacgccatgcttcagtttcttttcctgtcggcggattgtttcgacaaagaattgaaaatccatttcatgcaccttaaaatttaatctgcattcaaaccttttcactttggaagcaccatttatcggatgtcccttcgcaataaacaaattttcccgataccgccgcccatttcaacccaaacccaaaagctatgaaaaacctcatcgccttcaacaaaccctatggcgttatctgccaattttcaccgcacgaaaaacacaaaagcctcaaagactttatcaatcttcccggcttctaccccgccggacggctcgacaccgacagcgaggggctgctgctgctgaccgacgacggcaggcttcaggcacaaattaccgaccccaaattcaaacaccctaaaacctactgggcgcaactggagggcgtacccgacgaaagccgattggaaagcctaagaaaagggatagacttaggcggtttcgttacccgtccggcaagcatccgcatcttgaaacacggagaagcagattcgttatgggagcgcatcccgccgatacgcgtccgcaaaaccgttcccgatttttggattgaaattaccatttctgagggcaaaaaccgccaagtcaggcgaatgaccgccaaggcgggctatccctgcctgcgtctgatcagagtggcaagcggcaggctgaaactgtttgatttggatttaaaacccggggaatgggcatacgccccgtttaaaccataatcacgtttatctcatcatttccacaaaagtgggaatccggaattttatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccgctatattccgccatctctaagatttacagcgatacacgggtgatttaaggaatgcccgaaccgtcattcccgccacttttcgtcattcccgcgcaggcgggaatctagaatctcggactttcagataatctttgaatattgctgttgttctaaggtctagattcccgcctgcgcgggaatgacgaatccatccgcacggaaacctgcaccacgtcattcctacgaacctacatcccgtcattcccacgaaagtgggaatccagaacgtaaaatctgaagaaaccgttttatccgataagtttccgtaccgaacagactagattcccgcctgcgcgggaatgacgattcataagtttcccgaaattccaacataaccgaaacttgacagtaaccgtagcaactgaaccgtcattcccacgaaagtgggaatctagaaatgaaaagcaacaggcatttatcggaaataactgaaaccgaaccgactagattcccgcctgcgcgggaatgacggctgcagatgcccgacggtctttatagcggattaataaaaatcaggacaaggcggcgagccacagacagtacaaacagtacggaaccgattcacttggtgcttcagcaccttagagaatcgttctctttgagctaaagcgagacaacgctgtactggtttttgttaatccactataaatatccaattgaaatcttcagacggtatatcaaatttacacttttttaatgtttatgccgcctgaaaaaaatgctagtatatttcctaattgtctgactgtttattgttgaggaaaatatgagatcttctttccggttgaagccgatttgtttttaccttatgggtgttacgctatatcattatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctggcaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaaaggcagcccgcattttgtagaaaaccgcaatgccgtctgaaagcccttcagacggcatttgtttccccaaacgcatcatcctgccgcaagcctatgccaatccgttttatcgcatcggcaactcaaagaaaaatccatttcattcccacgcagggaagccggtttttgatttcggttatttttggttgtttcgggtaatttatgagtcgtcattcccgcaaaagcgggaatcagtttttttaagtttcagccatttccgataaattcctgtggctttagctttccggattcccactttcgtgagaatgacgtggtgcaggtttccgtacggatggattcgtcattcccgcgcaggcgggaatctagaccgttcggtttcggtttttttggttagtgccgcaacattaaatttctagattcccactttcgtgggaatgacggcggagcggtttctgctttttccaataaatgcccccaacctaaaatccgtcattcccgcgcaggcgggaatctagacattcaatgctaaggcaatttatcggaaatgactgaaactcaaaaaactagattcccactttcgtgggaatgacgtggtgcaggtttccgtatggatggattcgtcattcccgcgcaggcgggaatctagtccgttcggtttcggtttttttggctaatgccgcaacattaaatttctagattcccactttcgtgggaatgacggcggagcggttgctgtttttcccaataaatgccccccaacctaaaatccgtcattcccgcgcaggcgggaatctagtccgttcggtttcggtttttttggctagtgccgcaacattaaatttctagattcccactttcgtgggaatgacggcggagcggtttctgcttttcccaataaatgcccccaacctaaaatccgtcattcccgcgcaggcgggaatttagacattcaacgctaaggcaatttatcggaaatgactgaaactcaaaaaactggattccctctttcgtgggaatgacgtagtgcaggtttccgtacggatggattcgtcattcccgcgcaggcgggaatctagacattcaatgctaaggcaatttatcggaaatgactgaaactcaaaaaactggattcccgctttcgtgggaatgacgcgattagagtttcaaaatttattctaaatagctgaaactcaacgcactggattcccgcctgagcgggaatgacgaagtggaagttacccgaaacttaaaacaagcgaaaccgaacgaactggattcccactttcgtgggaatgacggaatgtaggttcgtgggaatgacgggatgcaggtttccgatggatggattcgtcattcccgcgcaggcgggaatctagacattcaacgctaaggcaatttatcggaaatgactgaaactcaaaaaactggattcccacttttgtgggaatgacgcgattagagtttcaaaatttattctaaatagctgaaactcaacgcactggattcccgcctgagcgggaatgacgaatttcaggttgctgtttttggttttctgtttttgtgaaaataatgggattttagcttgtgggtatttaccggaaaaaacagaaaccgctccgccgtcattcccgcgcaggcgggaatctagtccgttcggtttcggtttttttggctagtgccgcaacattaaatttctagattcccactttcgtgggaatgacgggatgtatagtggattaacaaaaaccagtacggcgttgcctcgccttagctcaaagagaacgattgtctaaggtgctgaagcaccaagtgaatcggttccgtactatttgtactgtctgcggcttcgtcgccttgtcctgatttttgttaatccactataaatttaatccactatattttttgttccaaagtcaaaatatgccgtccgaacattcgggcggcagacaaaacggcactgcccgataaaggcagtgccgttgtccgtttcaaaccgtgaaacatcagcccaaattaaaggctttatgcaataccctggttgccagttccatgtatttttcatcaatcaatacggaaactttgatttcggaggtggaaatcatttggatgttgataccctcttcggcgagcgtgcggaagattttggcggctacaccgacgtgcgaacgcatacccaaaccgactgcggagactttgcatacggtgtcgtcgccatcaatagaagccgcgccgatactgtcttggcgttccgacaggatttccaaagtctgcttgtaatcgccgcgcggtacggtaaaggaaaaatcggttgtgccttcgctgccgacattttggataatcatatcgacttcgatgttggcatcggcaaccgcgcctaaaatctgataggcgacgccaggtttgtcgggtacgccgcgcacgttgatgcgggcttggtttttatcgaatgcgataccggttacggcagctctttccatgttgtcgtcctcttcaaaggtaattaaggtgccattgccgccgtcttgcaggctgctcagtacgcgcaggcgcactttgtattttccggcgaattctactgaacggatttgcaaaactttcgaaccgaggcttgccagttcgatcatttcttcaaatgtaaccgtatccatgcggcgcgcttcgggtacgacgcgggggtcggttgtgtaaacgccgtctacgtcggtatagatttggcactcgtcggctttgagcgcggcggcaagcgcgacggcggaagtgtcggaaccgccgcgtccgagcgtggaaatatcgccttcactgctgatgccttggaagccggcaacgatgacgactttgccggcggtaaggtcggcacgcattttttcgtcatcaatgctttcgatgcgggctttggtgtgggcggtatcggttttgagggcgacctgccagcctgtgtagcttttggcatccacgccgatgtctttcaatgccatcgccaaaaggccgatggttacttgttcgccggtagctaagacgacgtccagctcgcgcggatcgggatgctcttgcatttcgtgcgccagtgcgaccagtcggttggtttcgccgctcatggcggatacgacgactacgatgtcgtgtccttcggcgcgggctttggcgacacgtttggctacgtttttgatgcgttcgggcgagcctactgatgtgccgccgtatttatgtacgattaacgccatgtttcgtgctttcttgtgggggttgtcgggcagcttggtttgctggaaaaagggttattattactattttttacatggaattcaagaacggactgcgctttcccgcctgccgtttgacagcggtcagcgaaaaacctgttctttcagattgttgacaaaatgccgtctgaacggttttcagacggcatccggacgacaatcaggcggcggacaacgcattttgctggtgttgcagcagttcgcctatgcctttttgcgccagtgcaaccagtttgcccaattcgtccaaactgaacggcgcgtcttccgccgtcccctgtatttcgatgatttttcccgatgcggtcatgacgatattcacatcactgtcgcaaccggagtcttcgggataatccaaatccaaaagcggcacgccgttcactacgcctactgacacagcggcaacggcttcgcggatggggttttcactcaaaatgccgtctgaaaccagtttgccgacggcgatttgcagcgcgacaaacgcaccggtaatcgaagccgtgcgcgtaccgccgtctgcctgaatcacatcgcagtcaatcaagatttgtcgttcaccgagtttttccatatccacgaccgcgcgcagggaacgcccgatcaaacgttggatttcttgtgtgcgcccggactgtttgcccgccgaagcttcgcggagcatccgggaagcagttgaggcaggcagcatcccgtattccgccgttacccagccttggtttttaccgcgcagaaacggcgggacgttttcatctatggaagcggtacaaatcactttggtattgccgcattcaataaggcacgaaccgtccgtatgcggcaggaaatgaggggtgattttgatatcgcgcaggctgtcggcggcgcgcgagatgcggatgtaatcaggcatactgccctcccgttaaaaacagataaattaaaaagccttaaatatgaaaaatcacatttaaggccttcaaactgaaaatttctacgcctcttcggctttgctgcggataatcaaaagcggcaggtggctttggcgcattaccgtttcggcaaaactgcccattaaaaggtgcatcagcccggtacgtccgtgcgtacccaacaccagcaggtcggcaccgttttcatcggcataatcaaccaaatcctgcgccatttcacgcgcacccttattggcaaccagcaggtgtttgacggtattttccacacccagttcctgggcggtgcgctcggcggcatccaaaacttcgttgccttgcgcgacggcggcggcttcgtagctttcgtgttgcaaaaattcgggggcgagtgccatatattcggcaggattggcaacgtgcaccaaagtcaggcgcgcaccgttgaccccggcaagctcggcggcatgtttcagggcattgatggacgtttcactgccgtcaacggcaacaaccaaatgtttgtacatatcgtattctccttttgcaccgcctcgcggtgccctcttgtcggatgggcgcagggacagtttgcgctgtttcattatagacccgccgtcgggctttatacaacagccgaacagcccgaccgctttccagtataatatgccgcttccgtgcagtcaggcattttttgccggctttcgttcactttttgatttgacgcaatcttgcaggattcgaccatgtccgacaacgctttgacctcttcgcgacgcttcggcggcatcgccagactctacggagactctgccttggcgcacttttcacaggcacacgtctgcgtagtcggcgtgggcggtgtcggctcgtgggcggtcgaggctttggcgcggacgggcatcggacgtttgactttgattgatttggacaacgttgccgaatcgaatgtcaaccgccagctgcacgccctgaccggcgacttcggcaaagcaaaagttaccgccttgcgcgaacgcattacacaaattaatccgcaatgcgaagtgtttgaaattgaagatttcgttaccgaagacaatttgccggaatacttcggaaaaggttttgatttcgtcatcgacgcgatcgaccaagtgcgcgtcaaagcagcaatggcggcttattttgtggaacgcaaacaaccgtttgtcctcagcggcggcgcgggcggacaaaaaaatccggcgttaatccaaaccgccgatttgagccgcgtaacccacgacccgctgcttgccaacctgcgctacaccttgcggaaacgctacggattcagccgcgatacgaaagcaaatatgcgcgtgccttgcgtgtattcgaccgaaaatatcgtgccgccgcagtctagggaggcttgttcggcagatgccgctccgcaaggcttgtcgtgcgccggctacggtgcaagcatgctcgttaccgcttcgttcgggctatattgcgcacaggcggcggtggaacacatcgcagacaaaaaataagcaatgccgtctgaaacaggattcagacggcatttgaacaaactatggttatgatttaagacaacaaaggatacggataaaaaataacataaaatatatgattcctaataatataccaagtatcggagagctatttaatggaattcgttaataatttagttattttttcatttttattactaatgcttattccgatattttttgtagtatatggtatataccataagatacgttatcgcaaaatatgtatcctaagaacaagttttatattattagtggtaatactttgcagtatgtattacatatattgccgttatcttgaccaacaaaaagtagcttattattgcatagatgaacaatgtatttctattgttcatctatacaaagattatggtataaactctcccacatatgcgagaatttacgcaggaaaaatattgtttagatttcaagtaagagctaaaaattacgctgaattacttatggaagatgatatatcaattagtaaaaaaattttggggaataaatttatcatttatgggtcgctacctgtaatatacggtaatgtagataatattgaagtaaaagaagctactggttatatagatagatccagtactgattatattgtctcaagaaacttaaaattcagacatttatattaattaagaggttttagcaagagtgccgtcaaaatatagggcgcatcatcgaattcgcgaaagacaaacgctacgatgaacgtttcaaggatttgaaaaaagaatccataggctatctgaaccggcatcccggtttggtgtccgactacctgaaggcggcaatcaagctgtcggttcagaaaaaccaacatcagcacgcctaaaaccgtattcacaacctgctccttttcaaaacatttgcatttaaaagccgttataatgccgtctgaacatctgcccgaccacattatacgtgaatgtcggcagattgttttcttttgtaaacttatattaaaatccacttaccgattcacgccatgccgcccatccctgccccatctgcaccatccgagcacactgtcgcatgggtattcggccaacccgttaccgatttgccccaggatttgtttattccgcccgatgcattgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaatacgccccaagccgccaccaaaaatcgggagacacgccatatgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaaaccggcagaaaaagcgcacaattcctgtttctgccgcataaaatcttttaaaataccgcctgatttgaatttaaccgaaagaccgaacttcatgaacctacatcaaaccgtcgaacacgaagccgccgccgcctttgccgccgcaggcatcgccgacagccctattgttttgcagccgaccaaaaacgccgaacacggcgatttccaaatcaacggcgtgatgggtgcggcgaaaaaagccaaacaaaacccgcgcgagttggcgcaaaaggtcgccgaagcattggcggacaacgccgtgattgaaagcgcggaagtcgccggtccgggcttcatcaacctgcgcctgcgccccgaatttctcgcgcaaaacattcagacggccttgaacgacgctcgtttcggcgtggcaaaaaccgacaaaccgcaaaccgtcgttatcgactattcttcgcccaatctggcgaaggaaatgcacgtcggccacctgcgttccagcatcatcggcgacagcatttcgcgcgtgttggcatttatgggcaataccgttatccgtcaaaaccacgtcggcgactggggtacgcagttcggtatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgttttggcattgtggaaacagtttgtcgatatttcgctctcgcacgcccaagccgtttacgacacgctgggcttgaagctgcgtcctgaagacgtggcaggcgaatcgaaatacaacgacgatttgcagcccgtggtcgatgatttggttcaaaaaggtctggcggttgaggacgacggcgcgaaagtcgtgttcttggacgaatttaaaaacaaagaaggcgaacccgccgcatttatcgtgcaaaaacaaggcggcggcttcctctacgcctccaccgatttggcgtgcctgcgctaccgcataggccgtctgaaagccgaccgcctgctgtacgtcgtcgaccaccgccaagccctgcacttcgaacaacttttcaccacttcccgcaaagcaggctatctgccggaaaacgtcggcgcggcatttatcggcttcggcaccatgatgggcaaagacggcaagccgttcaaaacgcgcagcggcgacaccgtgaaactggtcgatctgctgaccgaagccgtcgagcgcgccaccgctttggtgaaagaaaaaaatcccgaattgggtgcggacgaagccgctaaaatcggtaaaaccgtcggcatcggcgcagtcaaatacgccgacttgagcaaaaaccgcaccagcgactatgtgttcgactgggatgccatgctctcgtttgaaggcaacaccgccccctatctgcaatacgcctacacccgcgtgcaaagcgtgttccgcaaagcaggcgaatgggatgcaaatgcgccaaccgttttgaccgaaccgctggaaaaacagcttgccgccgagctgctgaaatttgaagacgtactgcaaagcgtggcggacacggcgtatccgcactacctcgccgcctacctctatcaaattgcgaccctgttcagccgcttctacgaagcctgtccgatactcaaagccgaaggcgcaagccgcaacagccgcctgcaactggcaaaactcaccggcgacacgctgaaacaaggcttggatttgctgggcatcgatgtgttggacgtaatgtaaaaccgcaccgcccgattgcggacaacagcctcgccatccttatccgaatctgaaaaaagcggcgcgatacaccgtatccgccgcccctcccaaaatgcgaaacaaacaaacgccaagcaagcaagcaagcaagcaagcaagcaagcaagcaagcaagcaaaaaattataacccccttcctgccgacgcacgcactttccgcgcggcgcattccccttttcccgcccctcaaatccgccttttcttcaggcagggtttcagcccgcctcttttccctgttttcctttccccgacacgcgtgcgctccccctgccgcactgtgctgcactttcgcgcccggacggcatcgttccgccatccggttctctgttttacatacccctgtttcagaaagaaatgcagatgtttcaacacacaggacgacacataaagcaccgccctatgtgttgccctgatttggaaggggttacgcctcccaaataaagtctgatcctgccgccccgaaggacagatgtccgagtggcgaagtttcaaccgaaaaggaaatacgatgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataacaacaatgccgtctgaacgcaccaacagccttcagacggcattttgcagacagaccgacccttcaagcccacttttttcatcatctccgataaattgctttgtatagtggattaacaaaaaccagtacggcgttgcctcgccttagctcaaagagaacgattctctaaggtactgaagcaccaagtgaatcggttccgtactatttgtactgtctgcggcttcgtcgccttgtcctgatttttgttaatccgccataaagaccgtcgggcatctgcagccgtcattcccgcgcaggcgggaatccagaacgtggaatctaaagaaaccgttttacccgataagtttccgcaccgacagacctagattcccgcctgcgcgggaatgacgggattttaggtttctgattttggttttctgtccttgtgggaatgacgggatgtaggttcataggaatgacgtggtgcaggtttccgtatggatggattcgtcgttcccgcgaaagcgggaatccggaaacccaaagccacgggaatttatcggaaaaaccgaaaccgctccgccgtcattcccgcgcaggcgggaatctaggtctgtcggtgcggaaacttatcggataaaacggtttcttcagattttacgttctggattcccactttcgtgggaatgacgggatgtaggttcgtaggaatgacgtggtgcaggtttccgtatggatgggattccctcttgcgtgaggctgacagatgccgtctgaaagactttcagacggcatagctttttctctttgaatttatagtggattaacaaaaatcaggacaaggcggcgagccgcagacagtacagatagtacggaaccgattcactcggtgcttcagcaccttagagaatcgttctctttgagctaaggcgaggcaacgccgtactggtttttgttaatccacgataaatttgccacaaaaaagctgcctcaaatgaatacccgggcagctttttgttgatatgactccaatcagcggtgttgcggattgtaacgtttttccaaacgcaggaatatccagcctaagaaagtcgtcatcaacagataaatcagggcgacggtgtaaagcggttcttcataaaccgaataccggcccgtaatcgtattctgaacatacgccaactccgccacagcaatgaccgacagcagcgagctgtctttcaagagcgtgatgaactcgctcgccaaaggcggcagcatgcggcgcaatgcctgcggcagaatcacatagcgcatcgcctgcggataggtcagccccaaagaacgcgccgcctccatctgtcctttgtctatagactggatgcccgcgcggaaaatctcacagatatacgcccccgagttggcgatcagtgccaaagaaccggcaatcagcggcccgtatccgcgacgcagcgcgattgccgcctcgccgctgaccaaaatgccgtctgaaggatggacgaaaaacggaaaccacacatacgcccaaatcacaatctgcacaaacagcggcgtaccccggaacagcgtaacatacagcagcgaaactttacgcaacgcccacgccagcacgcgcatcggcgcaccggctttttccaagtgaatcaggcgcgccaacgccaacaacagacccaataccgaaccgcccgccgttgccacgaccgtcagccccaaggtcgtcagtgcgccgtaaagaaacatccagcggtattcgtaaataatgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaacgtcaggattacccttggcagggatagatgactttcgcaccctcttccgtccccaaaatcaacacatcggcggcatcgcgggcgaatatgccgttttcgagcacgccggtgattttgttgatttcgtcttccatcgtcagcggctgatcgatattcaagccgtggacatcgacgatttggttgccgtaaaacgtggtgtagccgatacgcagttcgggctgtccgcccatagcgagcagtttgcgcgaaacaagagagcgcgcgctttcgacgacttccacaggcagagggaatttgcccaaacgtgaaacatatttgctttcatccgcaatgcagatgaatttttcggacgcgctggcgacgattttttcgttgaggtgcgcgccgccaccgcctttaatcatttgcagggcgtggttcacttcatccgcaccgtcgatatagaccgccaaccccgatacttcgttcaaagaaacgacgggaatatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctgatgttttgaattgaagttcagacggcatcgagcagcagcctgacgatgtatgcgtcctgcggctgcgtcagtttcaaattgcgcacgtcgccctgtatcagtagcggacgcacacccaatttttccacggcggacgcttcatcggtaatgccgtccaagttttccgcagccaatgcgcggtgcagcagcccggcgcggaaaagctgcggcgtttgcgcctgccaaaggctcgtccgctcgacggttgcactaatgttcccaccgtccgcgcacttgagcgtatcggcaatgggaattgccaaaatcccgccttcggcggcgttgcccgcctgttctatcaaccgcgtcaaagcttcagacggcaggcagcaacgcgcggcatcgtgtaccagaatattgtcggtttccgccgccaaaccggtttccaacagttttgccacaccgttgcggacggtttcggcgcgggtctgtccgccgtttttccacacccgaacctgtggaaatgccgtctgaaccttatcggcaaacgtgtcttcgggcgagacgacaacgacggtcaaatcgacggcctcatgccgttcaaaaatcccaatcgtatgttctaaaacggttttgcttccgatttcgacatattgcttgggtttgtccgcaccgaaacgcgccccgatgccggcggcgggaatcagcgcgatatttttgcgcttcatgcgtccgtcccgccgttttcagacggcacggcttccttgcgccagatacaggcttcgcccaagccgtccaaatattgcccgtgcgccgccaactcgttttcgtccgccctgatgactttcagtttgccgctgcgtttggtttcggtatgcaccacgggtttggtttccattttttcctctgcggccgcacccatcaggtcgaactgccgccgcgtcatagcaagatagacttcgcccaaaagttcgcagtcgatcaatgcgccgtgcaggacgcgcttgctgcggtcgacggaaaaacggttgcacaaggcatccaggctggctttctgcccggggaacatttcgcgcgccatcgccagggtatcggtaacggtacagccgagttcctcaacggtcggcaaccccatccggcggaactccatattgaggaagcccacgtcgaatttggcattgtggataatcagttccgcaccgcgcaggaaatcggcaatctgcctgccgacctctgcaaacggcggcgcgtttttcccttccaaaacctgtatcgtcaagccgtggacgcgtgccgcctcttcgggcatatcgcgctcggggtggacatagaggtgcaggtttttgtcggtcatttggcggttgaccatttccaaaccggcaaactcgaccaagcggtcgccgccgtcggcatacagaccggtggtttcggtatcgaggatgatttggcgtgtcgtcatatcggtgtctttcttctatcttcgtaaattgcttattttttaagcaatgtatttttctgttttcatttcaatgcacaaacccacttattcacagtgtgttcacaacattgggcaggcggattgtgtattttggggacaattttttcagacggcattcaaggttttttcctgattgccgccgcgcctaaaaaccgcctttcgcgcttaatcaaaaataccgacaacggaatattgcccaaagcgacaatcagatacaacaaggaaatgctgtcaaacaaaaacagcaacaccgcgctcaaaacggcagcggaaaccataaaaataccgttaacgatattgttggcggcaacggcgcgggcgcggaaagtctcgctactggcggtttgcagccaggtatagagcggaacggagaaaaatccgccgaaaaagccgatcagcgtcatcaccgccatcacgggatatgcccatccttgcgataaaaaccaaaaaatgccgttcagcccttcaaaacggtgtccgtgcgtcagccacaccaaaaccaagccgcaaaccgtcaaacccaacgcaccaaccgttacccaagccaacatcaggcgttccctgctgaacttggcacacagtaccgaaccggcggcaataccgatggaaaacagagcaagcatcaggttgaaaacattgtcgttgccgcccagatggatttgggtaaaggtcggcagttgcgtggtataaaccgcgccgacaaaccaaaaccacgaaataccgataatggcggtaaaaacgggcttgtgccgcaccgtttcacgcagcagggattttgtgccacggacaatattccactcaatttgtgtatcggcagccttggcgggtacggacggcataaacaggctgccgaccgtgcctccgacggcgaccagcaaaaccagtatcccgacaatataaggcggtacacctgccaccgccgttcccaaaatctgaccgaacaggatggcgacaaacgtacccgattcaatcaggctgttgcccatcatcaactctttgtcgtcgagataatcgggcaggatggcgtatttcagcggcccgaacagcgtcgattgcgcgcccatgcaaaacagacacgccaaaagcagcggggcagaccggatataaaacccgtatgccgccaccgccataatgatcatttccagcaccttgacccaacgcgccaaaacggccttgtcgaatttgttacccaactgccccgacagcgaggaaaacaggaaatacggcaaaataaacagcaacgcgcccaagttcaacatctgtccggcaggcaggaagccgttttgccccaaaccgtaaaacccaatcatcacaaacagcgcggttttgaacacattgtcgttgaacgcgccgagaaactgcgtagcgaaaagaggtgcgaaacggcggcttttaaccagtcccaaaccgccttttttagcgtacatcgttttccctctctttttcaatcagtttacttgtcgaatcatcatccatcaggatgcggtgcgccggcccttccaagtcgtcaaactgcccgtttttgcccgaccaccaaaaaaaccagccgatgacaaacgccaaaataatgctgatgggcaccaatataaacatgctttccatcacatattccctgtcaaatcgttcaaaacaaaagtctgccccgacacggtcagatattcgttacgcaaagttccgacgggagcttcgtcaaaaaacagctcgatacggtctttgaccacgcgccaatattgggggatttccgtctgaccgaacggcgacaggacatgattttccattccgccttcaagtttgacggcaaaacgcccgctttgcggccgtgcttccgattcgtcgtcggcaagcaggatgaaaaagcctatatgccgtcccgattggtcatgaatactgaaataatgcataaatttcccacccgccttttttcagacgacaccaactaaaaacagggcgaatgtaccagtttggacgggaagaatgcaaagaaattctccctcccccagccgaaaacaccggcaaaccgcatatcccccttttttccgtcaaaatgcctgacttccgccattttcacgcaaacgcccgattaagccaagcaattgcaaagattttttgctagaatagcctgcttcttttatcaaccttttcagacggccccactactttcccgcccaggaaggcaaaacggattcggcacgaatccggttagtatccgtgtccgattccaatgccgtctgaaactttccggagtaagaaaatgtcccaaaaattgatcttggttttgaactgcggcagctcgtccctcaaaggcgcggtcctggataacggcagcggcgaagtcctgctcagctgccttgccgaaaaactcaacctgcccgatgcctacatcacattcaaagtaaacggcgaaaaacacaaagtcgatctgtccgcacatcccgaccacaccggcgcggtcgaagccctgatggaagaactcaaagcccacggcctcgacagccgcatcggcgccatcggccaccgcgtcgtcagcggcggcgaactgtacagcgaatccatcctcgttgacgacgaagtcattgccggcatcgaaaaatgcatcccgctcgcccccctgcacaaccccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgttacggcgcgcacggtaccagctaccgcttcgtcgccgacgaaaccgcgcgcttcctcggcaaagacaaaaaagacctgcgtatggtcattgcccacttgggcaacggcgcgtccattaccgccgtcgccaacggcgaatcgcgcgacaccagtatgggcctgaccccgctggaagggctggtaatgggtacgcgcagcggcgacatcgatccttccgtattcggcttcctcgccgaaaacgccaatatgaccatcgcccaaatcactgaaatgctgaacaaaaaatccggtctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggtttggacgcactggtctttaccggcggcatcggcgaaaactccgacatcatccgcgaacgcgtgatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgacactgcccgtttgagcggtctgtaaggttttatccgcacacgaactgcctccggaaatggaggcagtttttttatccggctttccatgcttaaacagcactgcctcttttcagacattgacggttgcagccgcttacctgaaccttatagtggattaaatttaaatcagtacggcgttgcctcgccttgccgtactatctgtactgtctgcggcttcgtcgccttgtcctgatttaaatttaatccactataatgattaactattttttaatcatgttattattttccataaaatacatgacattaagatgtttttccacaaaagatacacacaccggcaaacaccggctgtgtttatcttttcttatgcctattttttaatcatcgtatttttatcttttaatttcaatacgcaaactaacttatacacacggttttcacatctttagactgcttccgtgtgtatagtggatattgccgttttcctttctgacaaaaatgccgtctgagaacttcagacggcatttgaaacatcggaatcagcggttttgttcataccactcgataaacttgtctgctttgacaaaacccagcagcggctcgctgcggctgccgtcggagcggacgacaaacacgcccggcggcccgaacagaccgtattctttcaacaacgcctgatgttcgggcgtgttggcggttacgtcgatttggaaaaagcgttccatatcgactgcctgatgcacttccggctgattgagcgtgtaagccgccatttctttgcaggaaatgcaccagtcggcataaaaatccaaaacgacgggtttgtcgggatgttctttcaacgccgtatccatcgctgccttcagcgcggcagtatcggcaaacattttgccgtgttccgaagatttgcctgcttcggctggtggattgagggtcaggaaatggtgcagcgcggtcgttttgccgtttgcgccctgccagccgaaccacgcgccgcctatcagcaatataccgcccaatgcgaatgccacagctttcggacggcgtttctgcctgcgtccgttgaccagcagcataaaggcaggaaccagcatcagcagcgtgtacagcgcgacgacgagataatagggcaagtgcggcgtggcgaggtaaacggcgacggctagcaggatgaagccgaatgcgtatttgacggcattcatccaatcgcctgccttaggcaggatatgcccgccgaacgtgccgatggcaatcagcggaacgccggtgcccaacgccaaagtgtaaagtgccaaaccgcctaaaaccgcatcgcccgtctgaccgatgtagcccaaagcaaatgccagcggcggggcgacgcacggcccgacaatcagcgcggacaatatgcccataataaagacggaaacgattttaccgcctgaaagcctgctgctttgattctgaaaatacgactgcacggcgttgggaagctggatgttgaacagcccgaacatagacagtgccaagacgaccattaaagccgatgccgccaataccacccaagcctgctgcaaccatacggtcagcagtgcgcccgtcagtccggcaacaatgccgaccagcgtataagtcagagccaaaccctgaacataaacgacggacagcacaaacgcccgcgccttgcccgcctttttgtcgccgaccacaatactggaaacaatcggcaacaggggatacatacaggcggtaaaactcaggcccaaaccagcgagaaaaaacgccaaaagattggcgttgagcgtatcccaagacagcttgaaacggctgtcgccgccctcatcccccttcgggggcggcagcgccccgctgccgttttgagaggaaggctgcaaaaagcggtctttggcggatgccggttcgtcggtttgcggatggtaagtgccgttgccgaaaatatcaaactcggtatccacgggcggatagcacacgccggcttcggcacagccctgataggtcaaaaccaatttatacggttcgccgacagcctttgcataaggaaaggcaacctgcgcctcgtgatggtaaaccgtctgcctgccgaaaaactcgtcttccttctcttcgcccttgctgaaagaaggctgtcccaacaaatccgccggatcggtcttgccgacgattttcgcctgatacatatagtatccgtcggcaatcctgaaacggacgttcacaccgtcgtcggcaacggcaagctccggcacgaatgccttttccggcggcagcagatcgttcgcatccagcgcgaaagctcgtccgcacaacatcaaaaatacggcgaacaggcaaatcagttttttcataatcgaatccgtttcagacaaataatttgtctgcattataaatggtaaggttgacggtgggatttaatttatgtaaaacccgccattatccgaacctatttccataaacatcttatcgaacccgccatgtacgatgtcaatacccacgatgtccgccgctttttcgcccgcgtgtggcagcagcggctcaatccgctgcaactgagcgcactggaacagaaagccctccgcattgtcgaagcccatcccgaataccaccgttatctcgaacgcatcgaagaccatctggacaccgactggctgcccgaaaacggcgaaagcaaccccttcctgcatatgtcgctgcatctgtccgtccaagaacaggcgggcatagaccagccgcacggcatacgcgcaatccacgacaccctgtgcgccaaacgcggctggctggaagccgaacacgaaatgatggaggcactggcggaaacactgtggacggcgcaacgctacggcaccggtttggatgtcaatttctacatgacccgactgcgcaaactcatcggcttgggtgcagaagatcaagccagattgaacccgcatgaaatcgcctgaccataccaaccgcctgcaaaatgccgtctgaagcggaacaacccctttcagacggcattcattttcccccaatcatttccacaacgcctttttcagcataatcaaccaatccttcttatccaaaacggggcgttgtgcaaacacatcgtatcggcacgcgtccagtttctgcaaaatcaactgcgcccccaacacaatcatacggagttccaaaccgatacgcccattcagttcccttgccaaaggcgaacccgccttcagcatacggaacgcacgccgacactcatacgccatcagccgctgaaacgccgcatccgcccgtcctgccgcgatctgttcctcagaaacaccgaatttcaacaaatcgtcctgcggaatataaaccctgcctttttgccaatccacagccacatcctgccaaaaattcaccagttgcaaagccgtacagatgccgtcgctttgcgccacgcacaccgcatccgttttcccgtacaaagccagcataatgcgtccgacagggttggcggaacgccgacaataatcggccagctcgccgaaatttccataccttgttttaaccacatcctgagaaaatgcagaaagcaaatcataaaacggctgcaaatccaaaccgaacggcacaaccgcctcggcatccaatcgtgcaatcaaaggatgcgccgaccggccgcccgatgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaacacaaccgccgcgccggccgattaccgttaacctgttcataaactgtacagcacatatttcaatgtaaatctttgttattttattgcggtgtaacttttttacaacattcttaaaaccattccgacctgtctgccgactttcccaatccgccttaataaatcatacaagatactgaaattatattaatctctataatatttatccctatcgaatttttaacagcaaaaccgttttacaggatttatcaatccgcccgccagaaaacttttcattcaaacctttttcccatctgtacgacattgcaatcccttattccatagtgcataattacgcaaattcagcgatgaatttccaacccggtttgtagtatggtcgataaagacctatttgtttcaataatttaaattggttctaaaggttactaaaatgaaaaaatccctgtttgccgctgctttgttgtctttggttctggcagcctgcggcggtgaaaaagccgctgaagctcccgctgctgaagcacctgccgccgaagctcccgctactgaagcacctgccgccgaagctcccgctgctgaagcacctgccgccgaagctcctgctgctgaagctgccgctaccgaagcacctgccgctgaagctgccgctaccgaagcacctgccgctgaagctgccgctaccgaagcacctgccgctgaagctcctgctgccgaagctgcaaaataagcattttccgcttgcaaaaaagcaggatacgttcagtatcctgcttttttgatttttcagacggcatcagattcccttcctcaatcttctccctacccttccgacaaacatgcttgaccttcataccgaattttcccgactcctaccggcagatgaaattgccgaaccttctccgacgcttttaaaagaccagcgcaaccgctttacgtctgcaccagacatcattttgcagccgctcagcgttaaaagcgtgcaaaccattatgcgtttctgccaccaacaccgtattccggttacgccgcaaggcggcaatactggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggtagcgaaggtacattgggcattatcactgccgccacgctcaagctgtttgccaaccccttagacaaagcaaccgcatgggtcggcatacccgacatcgaatccgccgtccgcctgctgaccgaaacccaagcacactttgccgaacgcctatgcagttttgagctgatcggccgttttgccgccgaattgtcttccgaattcagcaaactccccctgccgacacattcagaatggcatattttacttgagttgaccgactcattacccgacagcaatcttgatgatcggcttgtcgaatttctttataaaaaaggctttaccgacagcgtgttggcgcaaagcgaacaagaacgtatccatatgtgggcgttgcgcgaaaacatctccgcatcgcaacgcaaactgggcaccagcatcaaacacgatattgccgttcctatcgggcgcgttgccgactttgtccgccggtgcgccaaagatttggaacagaatttcaaaggcatacaaatcgtctgcttcggacatctgggcgacggcagcctgcactacaatactttcctgcccgaaatcctcagcaatgaagtctatcgttacgaaaacgacatcaacagcacagtctatcgcaacgtccttgcctgcaacggcacgattgccgccgaacacggcataggtatcatcaaaaaacagtggctggacaaagtacgcacgcctgccgaaatcgccctgatgaaaagcatcaaacaacaccttgatccatataacattatgaatccgggcaaactgcttccgtaaccggcatttctgatttgcatacacaacaaagaaagggacaatagatccgattgtcggtttagcgcgagctcgtgagtgcggttaaaaattggtggaaattacacgaaaaatgaccgcacttttaaaataaaaaaatcggcagtgaatttccctgccgattttattttgttacaacttaacttaaaacgtccactgtaaattcaacgcaccttgtttagcttgatgatgtttgcctgtttggcggttgaatgtggcttgtaaggttaagtgagatttgattttcactgctacacctaattggctctcaattgccgtcttattgtttatcactcgacgctctccgtccatttccacaccgaaaggtttgttgtggtaaagcgcgttcacagcggcgaaaggttcaatagcgatatttttatagagtgaaaattgagctttagcttgaacgccaacccgagtttgtaattggcgggagccaagtaaattcacgtgggcattttcgctatcgctgaattttccgtttacccccaaataagtcaattgtgcctgtggttgtaggtaaacacgaaggctgttgccctttttagtgaagtgttccgccaataacgcattgtaacctgcttcaattgaggcagtaataccttttgaagtaaaacgttctgtaccatcttcagtgttgatacggtggcggaagcgttgatattgcatccagctatccgcatacgcacctgtctgtttgtcctgaagttggtgccaagtggcgtaaacgcctgcaccaaagcctttcacatttcccgttgtaagattgtctgtatctgggttgtggaaagtgctacgttgttctgcttgtccgcccattaagccaatagaaagttgattactttcgttttgccatgtgaatacttcgccgccgagttgcacacctttacgatagccttctacaggtgctgttttgccttgcacccattggttggaatgtccgtcaatcacacgcaaccacaagcctttgcgtggtaaagtgcggtcgaaaatatcgctgtttttgttgttcaaacgcaaggcgaataaggtattggcggcttgagcctgttgtgcataaatcgccatatcatcgcgttcttgcactttggtaaaaaagccctctgggcgttgttgtaaagaaagcgtataaattcccttttggtgtttgccagaaagacggaatgcgtgtttatctgctgtgccatttactttgataatttgatgcccatcgaggctttttaaatcgtctattggattttcgaagatgatgtcggaagtgccagtaacatttttctcaaaaattaatgcagtatttttcgcttctttaggatcgtaagcaaaacgaaaacgagctccgccagcataatcttcttttacgagtaaactttcacttttagtattaaaacggatgtctgcattcgttgtttttaatttcccaacattagaatcccaacggggctcccagagagaattttctaagcggaattcatccaaactaatcgtttgcccgataacgtgcgagttgtctgtaacctcaatatagtggaatggatctaaaccagaatatagatgtgctgcaaaagaaacataattttcaatatgatgaattacttgattagcccattctgtataattcccgacagataaaatttcgctgttgatatgactattttttatttttggacctaaggagaatatatgactttttactataagaggatgggatccaaatttttcagcttggcaagtactataatcacgtatcttagtgttagaattaaaacattccttaaaatatttccgtatttgttcttctgtgtccccatttctttttgcaacccctaaacctcgggcgaagccaactaggtaaccttcggtatattcttgatcataaaaagaaatcttttttgagttattgatgttttcgaattggtatgttctagggtatagtgcgggaaagggtggaacttttggattatcctcggttataagataagtttcttttttccaatattcactcgttttatcgcggagtttttttaagcgggtaatttcatcattagtgagcttggttttgtcgtaaacgtaatcaacagccaaaagcggagaggtataaagaatagaaaaaaatagacttacaataaatgattttttaaacttctgcttgcttgcttgcttgcttcgagtttcataataaattttcctttgtcaagtaaaaataaatggggcgtggattttagcataaaactgaacaaaaaatgtcatttatctcacatttttctctatttatttcttgtttattaaaagtaaacgtttgctttttgctattttgtcaagccagtttgaaaatgtgtataattgccctcgttatttacaaaaatttcaggaaaaatgaccgcactttacccttggctaatgccaatttatcatcaaattgctcaaacctttgacgaaagcttggggcatcatgccgtgctgattaaagcggatgctggtttaggtgtagaacgtttacacatcaggcggcagccttgcccataccgtctgaagcactgtttccacaatcagcgcgtatgcttaatcaaccgctgtttctcgcgtttccaatccgcctctttcatactctggcgtttgtcgtgctgtttcttaccttttgccaaaccgatttccatcttgatttttccgcgtgaaaaatgcaaatccagcggcacgatggtgtagccggcacgttcggttttgccgattaatttgttgatttccgactggttcaacaagagcttgcgcggacgtacggcatctggtttaatgtgtgtcgaggctgtgggcaaagccgtaatatggcagccgaccagataaaacgcgtcttttttccaatagatataactctctttaagctgtacgcgcgcggcgcggattgctttgacttcccagccttccaagaccaaaccggcttcaatccggtcttcaatgaaaaaatcgtgaaatgcttttttattgttcgcaatagccataaacatcctatcaatatccgccgtcagacggcataaacccgaaaacagaacccatcataccgcctcttcaaccgcctgcacaatcttctcgggatacagcctgttgaggcagtcggtatgccccagcggacattcccgcttaaaacacggcgaacattccaagtgcaggctgacgattttcgccctatcgctcaaaggcggcgtatgcgtcgggctggaagaaccgtaaaccgccaccaccttcctgcccaaagctgccgccaaatgcatcaatccgctgtcgttacacacgaccgtgtccgccaacgacagcaaatccattgcctgcgacaaatcggttttgccgcacaaattgacacacataccgtctgaaaggcggttgatttcctcggcaatttcatcatctttttgcgaaccgaacagccaaacctgccaacccgccgccagataatgtttgcccaactcggcaaaatgccttgtcggccaacgctttgccggcccgaattccgcacccggacaaaaagccagaacaggctttccaatatccaagccaaaggtttcgacagaaatttcccgccgccgttcatcaatggaaaactcggggaatcccgaatgcccgtcaaaatcttcctgactcggatgcgcgagagccgtatatcgatccaccatcaaaggcagacgttccttatccagcctgcgtatatcgttcaacagaaaataacggctttcaccgacataacccgtccttttaccgatacctgtcgccagcgcgatgattgccgatttcaaagaaccgggcaacacgataacctgatcgtatccgcgccgccccaaatccctaccgacccgccaacggcgtttcaactccaacgcaccatgtccgaacgaattctcaagaatttcattcacttccggcatacgctcgaacaccgccatcgaccacttcggtgcgaacacatcaatcgtgcaaccggggtgaagttccttcaaacggcggaacaagggctgggtcatcacgcagtcgcctatccaactgggggaaataatcaggattttgatggacataacaagaaaccgaaatcagacaggcagaattttaccgcgaaaccgttggaaaacctatcttgccgcattccgaacgccggacgtgcaaatatgaaaaagcccgaacattcaagttcgggcttcaaaattctggctccccgacctgggctcgaaccagggacctgcggattaacagtccgtcgctctaccgactgagctatcggggaatggggcgtattatagcgtccggaaaaaatgtgtcaatccttaattttggaaaaatgggcgacaaaacgacaagcatatgaatcagaaagacattaagaccgatgccttaaaaggattgccgttgtatgaatttccacagccgtcatcacaccatatttaagcccgatgagccgttctgccctccccccgcttaaaacaatgccgtctgaacttcgccgtgttccaaagccagtaaaaactgtttgcggttcaacccgcccgcgtagccggtcagtttgccgtcgctgccgatgacgcggtggcagggaatcaggatagatactttgttctgcccgttggcggcggcaacggcgcggacggctttggggttgcccaaacgctgcgcctgctccttgtagctgcgcgtttcgccgtaaggaatcgccaagagcgcgtcccatgcctgcttttgaaactcggtgccaatctgctccaaaggcgtggcaaaggttttcagacgacccttgaagtataagtccaattcctgccgcaaaagttgcgtccgctcatcctcccgaaacacaaaccgtccgcgcaaggctttttggacggcggcaatttcctgttccaaatgcttctgtccgacaaattccagcaaacacaaacccctgctaccgaacaccgccagcatctcgcccaaaggcgtggcaatggcggcacacaccagctcgttcaaactgtcgggataacgcgcttccaacagacggatggcgcggcggatgcggacatattcttcaggcgcgcagccgatattgtcccaaaaatcccgctcgaactgtttggcttcgcattccgtcagattgggatgcggcataacgccgcactcaaaaacccgagattcgagccaatggcggatttcatcccattttgacggcagattgtttaaggaaggcagggtaatcatttgtttgctccgtatccctatcatagatttgacggcaaaatccccaatttttgccattcccgcacgccggagcaggaacgggctatgacgtaaatcttgagggttaggttgcggcaatacctaaatattcgatatttctaaagcatcagagaaaggaatgtttcaacacacaggacgacacataaagcgccgccccatgaaaaatttcagacgacctgcaaagggtcgtctgaaaccacgatttttgcatttgcgcattctggcacatcatccaaccgtttcggcacattcctgccgccgttgacagcctataatgaatccacttattcatcaagcaaaggaatcatctatgcaaaccctcatcctctccgccgtactgctggctttttcaaccgctgcctttgccgggggcgcattcacgctgcaattcgacaacccgtccgaagacggcggcttcacgcaaaaccagcttttgagcgcgccttacggcttttgctgttcaggcgacaatgcttcgcccgcgctgtcgtggaaaaatccgcccgccgggacaaaagtttcgtcctgaccgtttacgataaagacgcgccgaccggactgggctggatgcaccgggtggtcgccgacattcccgccgatgtccaccgccgcaacgcgacctcgctgcaattaagccgctgcgccaacatcgccgaccggactgggctggatgcactgggtggtcgccgacattcccgccgatgtccgccgccgcaacgcggcctcgctgcaattaagccgctgcgccaacatcgccgacgaccagtccgcagccatatcggcggtaatcagtttgcggatttgccgcatcaggttgacgccttcgtacacggcaaaaccgatgccgtcatgctgcaaccacgccaacacgccgcaaagcgcggcctccgcagcattgtgcggcacttcttcatccgccagtaccgcagcctcataatcaaacgccgcgcccatacgcccggaatacggcagctttaccgcatcgcacactgcctgcgccgtcccgtattgtgcggcgaacctttctacggtttcctgttcgaaagcaatccattgcgcctgatagaggccgtctgaatcgggaatattgatgacgtcaaacgtctgtccgcctgccaaggcgaccgccttacccgccgcagcttcttacttccgcgccgcacgataagcacagccggttcatataccgccacgctgcggtacaaggcggtatgatgttgcacgatgccgcctaaagcacccaatcgttcgcgcgtatgaaagtatagtggattaaatttaaatcaggacaaggcgacgaagccgcagacagtacaaatcgtacggcaaggcaaggcaacgccgtactggtttaaatttaatccactatatctcaaacccacgttaggtctaagcaaatggtcggacatccttatccgacagcccatcttcttttcagacggcattgcaaatttaagtttgacgtgcgttcaaaataaggcagttaatgcgaagcgaaattccgtcggcgtacctgcaacttggcccctcccctataggggagggtcggagggagggtaaaacggggcagatacagacaatatttccgttgccgccccgatgccctctccctaaccctctcccacgggagagggaatggattgccgttgaaataaatcgctctacataaaaaatcaatgtgttatctcaaacccacattaggtctaatcaaatggtcggatatccatattcggcaagcaagctgctttcagacggcatttccagccaacaagcgcgccaatatcccctcatacaccgcagacagcttcggaatgtcgtttagccgcacgttttcgttgatttggtggatggtcgcattggacgggcctaattcgataagttcttgcgcaatggctttgatgaagcgtccgtccgaagtgccgccggtggtggacaattcggcctcaatgccgcaggtttcggcaatggctgcgcgtgccacgtcggtcagtttgcccgcttgggtcagaaagggctgccccgaacacgaccactgcaaatcgtattgcacgccgtgtttgtccaaaatggcgtggacgcgttgtttcagccctgcttcggtggactcggtggagaagcggaaattgaatttgacgttcagctcgcccggaatgacgttggtcgcgcctgtgccgccgttgatattggaaatttgaaagctggttggcgggaaatattcgttgccttcatcccagacttcctgcgtcagctctaacaaggccggggcaaaagtatgcacgggattgattgccaaatgcggataggcaatatggccttgcttgcctttgacggtcaggttgcccgacagcgagccgcgccgaccgtttttaatcatatcgcccaatttgtccacggcggtcggttcgccgacgatgcagtagtcgataagctcgtcgcgcgctttcaatacatcgacgactttggtcgtgccgtccaacgcgtcgccctcttcgtcggaagtaatcagaagcgcaatgctgccttggtggttgggatgtttggcaacgaagcgttcgcaggcggtaacgaaacaggcaatgctggttttcatgtctgccgcgccgcgcccgtataatcttccgtcgcgctcggccggttcgaacgggggcgaatcccatttttcgacaggacctgtcggtacaacgtcggtatgccctgcaaaacagacgacgggagctttcgtgccgcgtcgcaaccagatgtttttggtgtcgccgaaatggagttcttcagccgcaaaaccgattttgtgcaggcgttcggcaaggagtttttggcaatccctgtcgtcaggggtaacggatggtcgggaaatcagctctttggcaagctctagggattgagtttcggtcatatttgttcacttttgaaattagaccgtctgaaacgttctgaatgtgattttcagacggcatttaggttaggttggcatacggggtgggtattttacccatcagtcttctgaatcatttgccgtggcaggcttcgtaaagcggcagcaaatcttccaccgtttccgctatccatttcgcgacatcctgcctgcccaaatcgtcgcgttcgatgtgtttgccgatgcagaaaaagtcttcgtcgttttgcaactttcggtcggactcgttttgttgcgcgacggtgcggtagtcgtcgtattcgctttccgcaccgtgccacatatcgaaagaagcgtatttttcggtatcaaaattatccaaccagcggttgtaatcaggcagcgcgatgggggaaacatcggctttatagcagtgccaatccaagctgacgctcagacggcggcggttgagcagtatcgacaaaatcgctgcggaatttttatattgttcgtatttgaagtaggcaaagaaatgggcgcgaacctgccagccgttacaccagcgttcgatgtgcggcggcgcaaacggcgcacccaattcggcggcaacctgctgaatcagctgctgccatatctgccagttttctttatagtcagccttgatttgcggaatgctttcaggctggtattttttaagctgggaaaattggaaaaacgggatattgaacaaatcgcaacttttcggggtcagcataatatatccttgagacgattgtttcagacggcattatttgcgccggcgcgccgccataatttcgccgatttcggtcagtttttcttttgggataaaggtgttgcccatatcaaacagcggctcttcaatcgccaaatgaacatcatatcccgccacaaaacgtttgaacgcttcctcatcggggacataagcgttgtctgcttcgagtttggcaaattcggcggaaacagccgcccagttgtcgtgcagcccgatatgttggcgcaaaagctcgtccacgctttcttgggcttgcggcgcatattgcagcagcagcgggaagaagttttcttcttcgtcttcatggtgcagcggcgcggcaacgttgaaatactgggcgatttggcggatggtttgcaaaacaatctgattgcagccgttttcggcgatatagtccgacagcatggcgacttgtccgcaaaaacggcgcactttgccgtggcaggcatacagcatttcaatcggttcggcaaaggtaacgcttttggtttcaaacggattcatgttttcgttctcaacgggcacttttcaagcagtcattttataataaaacagcctgcacaaagcaggctgtccgtcttttgagactttaagcggattaatcgaccaaagtcactttgccgttcatcaaagcaccgtgacctgggaaggtacaagcgaatttatattcgccgtcggccaatttagcaggatccagagtcagggaagcttcttcgccgccgccgatcagtttggtatgggcaacaacgcgtgcatcatcaggtttgacatagtcggtatcggcagcacctacgccgtctttaaatacgccgtccatgtcttcagctttggcaatcacgagattgtgacccatgctggctttgggttgcgtaccggtatgtttcagagtgatggtgaactctttacatgctttgctgacttggatgtctttggtgttgaactgcatattgtcgttggattcgacagttgccgcacagttgccggcagcaggggcttcggcagcatctgcaggagcagcttcggcggcaggcgcttcggaagcgggtgcttcagcagcaggagttgcctcggcagcaggcgcggcaggttcttgagagcaggcagccaaaccgataacggcggcagaaatcagagccagatacgctttcataacaaatctccaatcgataaaataatattcggttttacagaaatcaaagtgcaaccgccattaacaaaaccttgaaaaagattccgccgcgttgcacaaacagatgtttcggagcggcattttgctacaaatttcatttgaaatcaaagcctgtttgcaagtttacaatcgtttacccaaaaaagggcaattttaccccgaacctatttctttagtattagacctattatcctttacttcttaatattaacggatgtttacacaaattcccgtatacattttatgcgccatgccttctaaccaagtttgccaatgcctccgccaattcgggatgccgtttttccaactttgccgccgccgaaccgaaactctccagcgcagccttactcaaatgcagggtattggttttcggcggtttttccggtttcgggaccagcctgaccgaaacagagcgtatcgaagcatcaagccctgccaactgcggcaataccgacggtgcaatcattttcaagcgcgatgccgccatattgtttgccgccaaaaggacaagcctgccgtcttcgatacatgccgtctgaaaatgcgggtgcaggttggcaggcagcagttttttcacggcggcatccaaccgccgccactgtcccgcctgtttcaaaagtccggaaagcagcgcgtcccgcctgcccaactgttccaaattcataaaacatacacccaaaaagattgaaataccgcaaacgcgcctttatttcagacggcattagcactttgcacaaacgcttgtgttaaaatcgcgttttcgcccactattatatcaggcgcaggaattattcatgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcaccctcggtatgcgccacttcgacgtgcagcttatcggcggtatggtgctgcacgacggcaaaatcgccgaaatgcgtaccggcgaaggcaaaaccttggtcgccaccctcgccgtctatctcaacgcgctggccggcaaaggcgtacacgtcgttaccgtcaacgactacctcgcctcacgcgatgcgggcattatggagccgctctacaatttcctcggccttaccgtgggcgtgattatttcagatatgcagccgttcgaccgtcaaaacgcctatgccgccgatatcacctacggcaccaataatgaattcggcttcgactacctgcgcgacaatatggttaccgaccaatacgacaaagtgcagcgcgaattgaattttgccgttgtcgatgaagtggattccatcttgattgacgaagcgcgcactccgctgattatctccggtcaggcggatgacaacatccagttgtaccaaatcatgaacaccgttccgccccacctcgtccgtcaagagacagaagaaggcgaaggcgactattgggtcgacgaaaaggcacatcaggtcatcctgagcgaagcaggtcacgaacacgccgagcaaatcctgacccaaatgggattgctggcagaaaacgactccctctattccgccgccaatatcgccctgatgcaccaccttatggcggcattgcgcgcgcattccctcttccacaaagaccaacattacgtcatccaagacggcgaaatcgtcatcgtggacgaattcaccggccggctgatgtccggccgccgctggtcggagggtctgcatcaagccgtcgaagccaaagaaggcgtggaaatcaaacgcgaaaaccaaacgcttgcatctattaccttccaaaactatttccgcctgtacaccaagctctccggcatgaccggcacagccgataccgaagccttcgagttccaaagcatctacaacctcgaaaccgtcatcattccgaccaaccgccccgtacagcgcaaagacttcaacgaccagattttccgttccgccgaagaaaaattcgaagccgtcgttaaagacattgaggaatgccacaaacgcgggcagcccgtcctcgtcggcaccaccagcattgaaaactccgaactggtatccaagctgctgacccaagccggactgccgcacaacgtcctcaacgccaaagaacacgaacgcgaagccctgattgtcgcccaagccggcaaagtcggcgcgattaccgttgccaccaatatggcgggacgcggtacggacatcgttttaggcggcaacctgaagcaccaaaccgatgccatccgcgccgacgaaaccttgagcgacgaagagaaacaggcacaaatcgccgcactcgaagacggctggcaggcggaacacgacaaagtgatggaagcaggcggtttgcacatcatcggtacggaacgccacgaaagccgccgcatcgacaaccaattgcgcggacgttccggccgtcagggcgaccccggatccagccgcttctatctctcctttgaagacccattgctgcgcttattcgcactcgaccgcgccgccgccatcctcaaccgcctcgcccccgaacgcggcgtcgccatcgaacacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcagcgacctgatgcaggaaatccgttctgatgtcgtcagcgacctcgtggatacctatatgccgcccgacagcatggaagaacaatgggacatcccgactttggagaaccgtctggctgccgaattcagactgcacgaagacatccaatcctggctgaaggcggacaatgcgattgacggtcaagacatcaaagaacgcctgatcgaacgcatcgaaaacgaatatgccgccaaaaccgaactggtcggcaagcaggcaatggccgatttcgagcgcaacgtgatgttgcaggtcatcgacaaccaatggcgcgaacacctcgccgctatggactacctgcgacaaggcatacacctgcgcagctatgcccaaaaaaatccgaagcaggaatacaaacgtgaagcctttaccatgttccaagacctgtggaacggcatcaaattccatattgcctccctgcttacctcggttcaaatcgaacaaaaccctgtcgcggtggttgaagagcaacccatcggcaacatccagtccatccattccgaatcgcccgatatggaagaacttttgggtcagtcgcaaaccgatctggttaccgaagcctttaatcccgatgggacagatttcagccccgaagccttggaagcgcgggggcaaatcgtccaccgcaacgacccctgcccctgcggcagcggtttgaaatacaaacaatgccacggcaaactggcttaagcgtttgaacgcaaatgccgtctgaacatcccgctcccgtttcagacggcattttgcctgaaccgccacatccgactgccattccgaaaaatcccgatttcgtaccgtccgtaccaaaaacagacatcccgtccgccccacatcatgattccatccgacttcattgacgagcttttagccaaaaccgatattgtcgatattatcgacgagcaggttccgctgaaaaaaggcggggcgaactatatggcgtgttgcccgttccacaaggaaaaaacgccgtcgttttcggtcagtccaaccaagcagttttaccattgtttcagttgcggggcacacggctcagcgattggttttgtgatggaacatcagggactgtcgtttccggaggcggttcagttccttgccgaccgcgtgggtatggtcgtgccgaaagtgcacgggcaaaacgataatcccgaagtccgtgccgaacgtaagaaaaaacagcagacactggaggaaacgacggctgcggcagctgatttttacgcgcaacagctaaaattcaatccagcggcaaaagcttatttggacaagcgcggcttgagtgcagaagttatcgcgcattatggtttgggctatgcgcccgacggctggcagcctttgacgcaagtgttccaaccgtatcctaataccgcgttagtggatacggggatggtgattgacaatgagggacggcattacgaccgcttccgccatcggattatgttccccatccgcaatccgcgcgggcaggttatcggtttcggcggcagggtgctggacgactcgaagccgaaatatttaaattctcccgatacgcctttgttcgataaggggaaaaacctttacggactgtatgaagggcgtgccgctgtcaaggaagcggggcggattttggtggtcgaaggctatatggacgtggtcgcgctggcacagttcggcgtgggctacggcgtggcggctttgggtacggcgacgacggcggaacacgtcaaaatcctgatgcgtcaggcagacagtatttatttctgtttcgacggcgacagcgcggggcgaaaagcggcttggcgcgcgctggaaaacgcgctgccgcagttgaaggacgacaaatcgctgcattttttgttcctgccggaagaacacgaccccgacagctacatccgcgcctacggcaaagcgcaatttgaagacgcgcttctgaatcaaagcaagcctttgtcggagtatttctgggaacacctttcagacggcattcatctcaatacgcaggaaggcaaggcggaattggtaaaaaccagttcgccgcttttggcgcagattaccgcgccggcattggcttatttgttaaaacaacggcttagcgagctggtcggcatcgaccccgacaacctcgcgcaactgctaggacaggaagcgccgaagcggcacgtcaaacaaaaaaactacaaactgcctccgatttccgtcaaacagcccgtcatgctgacgctggtacagcggcaaatccgcagcctcttgataaatccggattgggctgcatatatagacctgcccgattatctggcgttggacggtgatttcgcctgccttgccaatcttgccgaatcgattaaaaaccatgccgccgtacccgaaaccgctcaggttttagagtatatgcgcggctcgccttacgaagaaacgataacccgaatcttccattcaacgcaccaatcggaagaaatgaacagcagcagtgaagaagattgcgagaatttccaaatcggcatgaaaaaactgctcaatgagttaaaatacagccaaatcgaaacattaaaacaaaaaagcctgcaatccggcttaaatgaaagcgagaaaaaacttttgctgtcgctgctgaccgcaaaacaaaattgaccggcggattccgccatccgtaaaccgttatgccgtctgaaaagcattcaccccggctgcaacaacgacacctgcagaacacccatccccaaaagccttcagacggcatcagagtaccctactctgccacgccttcaggtgcgtccaaacgcaaaccgtcggcatcttaccaacagaaagcagacaatgtccagaaaccaaaatcacgaagaatatcaagacgacacccgtccgttaagcattgaagagcaacgcgcgcgcctgcgtcagctcatcatcatgggtaaagaacgcggctacatcacctactccgaaatcaacgacgccctgccagacgatatgtctgatgccgaccaaatagacaatatcgtcagcatgatttccggtttgggcatccaagttaccgaacacgcccccgatgcggaagacatattgttaagcgacaatgccgccgttaccgacgatgatgccgtcgaagaagccgaggccgccctttccagtgcagattccgagttcggcagaaccaccgaccccgtccgtatgtatatgcgcgaaatgggacaggtcgacctgctgacccgcgaagacgaaatcatcatcgcaaaaaaaattgaaaacgccctgaaaaatatggttcaggccatctccgcctgcccgggatccattgctgaaatcttagaactcatcgaaaaaatccgcaaagacgaaatccgcgtcgacgaagtcgtagaagccattatcgacccgaatgaagtattgctcaacgaattgggcttggggcacttggaaaccacagcgcccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgattggccgtttggaaaaacaccacagccggcacaaagactatctcgcctaccgcgacgcgattgccaacaaactgctggaagtccgtttcgccacccggcaaatcgacagcctcagcagcagcctgcgcgggaaagtagaaaacatccgcaaactcgaacgcgaaatccgcgacatctgcctcgaccgcgtccatatggaacgcgactacttcatccaaaacttcctgcccgaaatcaccaatctagaatggattgaagaagaaatcgccaaaggcagggtttggagcgacgcgctcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtgatttccatcgccaaaaaatataccaaccggggcttacaattccttgatctgattcaggaaggcaacatcggtttgatgaaagcggtcgataagttcgaataccgcagaggctataaattctccacctacgcaacctggtggatccgccaggcaattacacgctcgattgccgatcaggcgcgtaccatccgcattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgacaaatcgaggcaaaagcactccgcaagctgcggcatccgacaagaagcgaccgtttgagaagtttcttggacagcgaagacagcaagctgtaaaccaaaaaaccgcaggtttcaaatacctgcggttttttcttacacaataaacaacgcttccacatatcccacactcctatcccgagacctttgcaaaattccccaaaatcccctaaattcccaccaagacatttaggggattttccatgagcaccttctttcagcaaaccgcacaagccatgattgccaaacacatcgaccgtttcccactattgaagttggatcaggtaattgattggcaaccgatcgaacagtacctgaaccgtcaaagaacccgttaccttcgagaccaccgcggccgtcccgcctatcccctgctgtccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcgttgatgccaccattattcagaccgctggcagcaaacagcgtcaggccatagaagtcgatgaagaaggacaagtcagcggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgtcgccgttgttggaagggttacccgaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttatcgaagacccgttatgtggtcgaacaaagcttcggtacgctgcaccgtaaattccgctacgcccgggcagcctatttcggactgattaaagtgagtgtgcaaagccatctgaaggcgatgtgtttgaacctgttgaaagccgccaacaggctaagtgcgcctgttgccgcctaaaaggcagcacggatgcctgattatcgggtatccggggaggattaagggggcgtttgggtagaattaggagatatttggggcgaaaacagccgaaaacctgtgtttgggtttcggctgtcgggagggaaaggaattttgcaaaggtctcatcctgttattttcacaaaaacagaaaaccaaaaacagcaacctgaaattcgtcattcccacgaaagtgggaatccagtgcgttgagtttcagctatttagaataaattttgaaactctaatcgcgtcattcccacgaaagtgggaatccaggacgcaaaatctcaagaaaccgttttacccgataagtttccgcaccgacaactctagattctcgcctgcgcgggaatgacgaatccatccatacggaaacctgcatcccgtcattcccacgaacctgcatcccgtcattcccacgaaagtgggaatccagttttttgagtttcagtcattcccgataaattgccttagcattgaatgtctagattcccgcctgcgcgggaatgacgggatttgagattgcggcatttatcaggagcaacagaagccgctctgccgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaacctacattccgtcattcccacgaaagtgggaatccagttttttgagtttcagtcatttccgataaattgccttagcattgaatgtctagattcccgcctgcgcgggaatgacgaatccatccgtacgaaaacctgcaccacgtcattcccacgaaagtgggaatccagttgcttgagtttcagtcatttccgataaattgccttagcattgaatgtctagattcccgcctgcgcgggaatgacgaattcatccgtacggaaacctgcaccacgtcattcccacgaacctacattccgtcattcccacgaaagtgggaatccagtgcgttgagtttcagtcatttccaataaattgccttagtattgaatgtctggattcccgcctgcgcgggaatgacgaattcatccgtacggaaacctgcatcccgtcattcccacgaaagtgggaatccagttttttgagtttcagtcattcccgataaattgccttagcattgaatgtctagattcccgcctgcgcgggaatgacggcggaaatcttgtttatattgaatcaaaaaaaacctgcaccttaatcagttggcggtttagtccgacttttggggtgcagatcaagctttcagacggtatttcctttaaaacttcatttcgagcgcgagactgaagttcctgcccggtgcggcataccttccatagttgctgtcgccgccgtgccggtttgccgtgctttccgcagtctggcgcaaggattcccaagtaacgtagcggtagttgccgatattgtagatagccgccctcaaggtcagccgttttttcagattcagataggcggaaacgtctgccgtcgaccaagaagacgacgctctttttgtcgaatatcgtttttgatcgcctgccagataagcaagctcgtcagggtttttccctttggaataggtcagcataatgtttgcgccccatttcccctcaggctggtcgtatccgaaccccaaaacataacgcgacggctgtaccgcatccaaagcatagctgcggagggacagtcccggccggttggataccgatttcggtttgatgcggttgtacgccaatgtggtgtacaaaccttcgggcagtttgccatacacgccgttccagtcgatttttcccaatatattaacgccttgaagcgacatattttgggcattgtaataatcgcgtatatcaatctctgtcaattgtcctgcctgattcggcaatttggttttgtgatcggcaacggcaatcatatcggtataacggttgcggaagctgctgatttccaaaaagccgaaatcgcccttccactgcaaaccgatttcccggttggctgccttttccgatttcagggcgggacgctgccagcctttcggataatcgtgataaatgtctatcccgaaaagttcttggaatgagggcgttctgaagccgctggaggcacggtaagacacggaaaaatgccggttcggtttgaacaagatgccgctgttccacgaacggtcaacataccgcccgctgcggacgagttcttccgacgtggtgaagtttttccggtcgtacctgccgcccaagctgaaatcgaaatatttgccgattgaaaaacggtcgttcaaagaaatatggatattgctgccgttgatttttcttggcacgcatttgcgggaacgcagggtttcgatgtagccgcagaccgacccttcgacgacttcgggcttacccaaaagatacttatcttgattgttttcatcgaatcccgtggattccgaaatccttgccgcattgtgggaaagctgttcggggcgggaaatcgctttggaagcatcgtaaccgaagcccaaagtcagatggtgtttcgtccatttgtttttcagcgatttctcaaacgaggcattcaaaacattgtgctgttcgcggtagtggaaacggtcgctgctgtcgtaggaatacggtttgtccgccgacgcgcggcaggatttgtccacagcaggatacacggcgcaattcagcttcagcgtgttgttatcggttgccacgccctgtttgtcaaacgacaacaccgccttatccgcccaattgtcagaatacgcttcgttttcataacgatacagcaaacccatacggcggcggcggtgatgttcgtcaataaatttggtgcgggaatatttcaaacctatgcccctgaccaaatttttatcgcccttccactcttctatattcggcacaaaatacaagccgtcgcggaaatcgtcgccgtcgtacaccccgctcttgtctctaaacttttccgcctcgtccgtaccgtaatactgtttttccgtcatatcgcggatatcgtaacgctgtttggtatcctcaaacacgccgccgacataatgcctgccgccgaagcggtagcccagcttggcaagccaagagccgctgcggtaatccatcggatcgggcaatatcctgccgccgcccgtgtaagcttgggcggacagattttcgtggcgcgcctgcgcctcccgcacctgcgcctcttcttcagcacttaaaggctgattttgttcaatacgttcttttacccagcggttgagctggttgttcaaatatttcccgtagcccgccaattttgccacgggcttggattcacgctcgccctctactgagaaaaatggctctcttgtcttgcgtttaatatcgtatgtctgacggaacgcgtccaaacggtctatgccgtattccaccccgtccgcaatatcgccgtgcgggcgcgtttcccgcccttggcgttcggttcggattaacagcccttcccaaccgtctttgctgaaccccgcgccgagcgacttcataaattggcggtttttactgccgtaggcggtttttgcctgtatcccccaacttttgccgtctgaaatcaggtctgccgcctctttggtgcggaaggcgaccgcgccgccgagtgcgccgctgccgtgatcggacgaaccggcacctttgtcgatttccaccgtgctgatgttttcatattcgatttcgttgattgcaccgctgccgccgcgtccgccgtatccgctcaacgatccctgcacggtaaacgcctgtatttgggcaacaccgtcgaccgaaaccgccacacggtttttatccacgccgcgtatcgagtagccgccgctcgcgccgttgccctgttcgacaaccgccacgcccggatcgtagcgcgtcaggtcgcggataccgagtacctgttctttgttcaacgtttccgacgttttgacgattttgcccaaaccggtcgcctctttcgatcgccgtcccactttggcggcacggacggtaatctctttcagggattgggtctgcgcggcatcaggtgtcgccccccccgcttgggcagcataagccggaaaagcggttgcaatggccaaggcagtcagagtcagcggaaaaccgtgtttcttattcatttttccacctcctgcatatctttcttcgcaccgaataccacgccgaattggtgtttaacttcagattctaactgtttgccaacatcaacttcagcatcaacttcagcttcaacatcaactttattttcagtaccttcagttataccaagagatttcccatcattattgaaaataataccgcccaattcctccgcctgcgggccgtaaaatcccccttctacacgaagattactagcttggaaggttttggggtcggtcgaaccatttcccgaaagattgatgccgttctcccgagtgcgtgctgtcgcgtagaaaccgttgccctcaatcttgccgttttcaatatggaaagcaggttctacaccgttttcctccgtcagcgttccggaaatcgatttcttgccgaaatcaacggtaaatactgcttttgccgcttctttatccgcctgattgtcccattgaatgggtttgccgatacgcgcttcccaagtgccggtatagtgtgcttctccagttttcggaatatccgtttccgccgtgcggatacctttcaggaaaaggtcgatgttcctgcctttaggggcttccggagcgggcaggatgccgtctgaaccgctgccgccttcttctgtcggcgattcttcttcgggttcttcagcttcatcttcaccttctacggcttcgtcttcttcgctgccttcgtcttttacggctgcgtcttcggtgccttcttcatcgtcgatttcgtcttcgccttcttcgacgctatcaacgcctgtatcctcttcgtccctctcttcgtcctgcgccttcggtttggcggcgggacgttcggtttgcatccgtccgattttcacataggtcagaaaatcgcagcaggttcggattgtcgttttcctaccatcggcaagctcgatggtttgttctttgtttaccaaaggaatttcacgcccttcgacaagaagtttgtcgggatgaccaaaatcgggcatagaggaaatggcaaactcacggggatttttatcacttgcctcgtcaacggaaattttcagagaatccaagattttggtgtgttttccagacgacagggcaggttttgtatctgctgcgttttctgtctctgttttttgtttgcctgcgaatacgccgaatacgctgttgtcgttgctgataaaccgtccggcaagctcttctccgttatcgccgaaaaaaccgccctcaagccgctgatcggcatcggtatggaaaaacaaatattctttatcagcgtgttgcgtcttcacctcggtgctaactttggcactgccggtaaagcggttgccgtccaatgttgcggtaatgtcgtaaatggtcagcggttttttgggctcatttggattacttttattttgcacatactgatttttaatcagcttgccattcagggttttgttatcaaaatcaaccgtatattcggcaggatgcttttccctgtcgtcggcatccctagcctcataagaagttgccccaatttcattaccataatatgtggtataacccaaatccgtactggaaaccgccttacctgtccgatgacgtttggcatcggtcatatattgccagttaccggaatattgcaccgttcccgcgctcggtaaagattgggaaggacgttctccggaataatatacaaaaccgtcataactaaatcggttaacaaactccttaccatcagaagtcttttctttttcattatcctttccttccgccctggtaaacacatagcccgcacggacaaattgatattgatatttttcttcttcttttttcgatgtgataaccctcacatcagaataccgttcgttgattttctttttaagtttgtcagcctgttctttcagcgtaccgtctaaaaacaggatatccttctctttaagcggcagatgctcctctgcctgatgcttgtcgggaatttccgtaccgtcttgtttataggaagcaatattccgccttggcagccgcattgccgcaccgacggcgggccggttgaccggcgtggtttctaccgaagacccggcagggggcggagtgggaacgtccttagatttgaaggtgacggggtacgcggtcggcgttgattcgacaacaggctgcacgccgaaattgccgccgatacaagatgctaaaagtaagggcaacaagacaatgccgccataattcggtttacacatccctacttttcctctatttgattaataataattatcattatattaatatgtacagataatatcaagccgtttttatagtgaattaacaaaaatcaggacaaggcgacgagccgcagacagtacagatacattccgtcattcccacgaacctacatcccgtcattcccacgaacctgcaccacgtcattcccacgaaagtgggaatccagttcgttcggtttcgcttgttttaagtttcgggtaacttctacttcgtcattcccacgaacctgcatcccgtcattcccacgaaagtgggaatccaggacgcaaaatctcaagaaaccgttttacctgataagtttccgcactgacagacctagattcccgcctgcgcgggaatgacgggatttgagattgcggcatttatcgggagcaacagaagccgctctgccgtcattcccacgaaagtgggaatccagttcgttcggtttcgcttgttttaagtttcgggtaacttccacttcgtcattcccacgaaagtgggaatccagttttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgaacctacattccgtcattcccacgaaagtgggaatccagttcgttcggtttcgcttgttttaagtttcgggtaacttccacttcgtcattcccacgaacctgcatcccgtcattcccactaaagtgggaatccaggacgcaaaatctcaagaaaccgttttacctgataagtttccgcactgacagacctagattcccgccttatatgatgcgctctatcaaaggggcgcattaattttcttaacattcccctttgacagccaagtgaaaggggcttttttatgtcagcagtaaatgtaatattttcctgttcttattggagaatatttaaaaaatcagattcttgtgttttgtgtttttatcagttcagacatggcgaaccgcataaactcattaatcaagagaatttttcaaagctttatcaggcgttcgattatatagattcggttggttcgaattttccagtgattatcacaacggatggttgtggtcttttttgttgatctttaaaagtttgtcaggatttggctttcggtcgttgaccgtcgtacgcgctttagcgcggaagacgggaaacggctgaaagccccccccttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaaaggaaatcaaaatgtttaatcaaactcaaactgtaacttatcctgcaacttttttgggagccaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcaggcagacgactatttattgtcgtcccttcctcctactgttacccaggacggaaaaatcatcaggccggaaagggtgggcgataaatggattttgaacggaaagccggttacgttgtcttatccggaatgttccaattttgagcagataaagcaaggttcttatgtcggttcgacggttctaattctgtttgtagtcatttacggtttcaggcttctgattaattttttaaaagacataggcaaggttgggactgattgatgattatagatttctggtttcttctcggtttcttcttggctttgtctgttgcttggctgttttggtaacggttggtagaatcggctttttagagtgttttaaaaggtccgaattatgtttatttctgaatatcatttagttaaatttcaaactgattcacatatttatagagatttaccacaagcgttaatttattatagggaattgattagaaaaggggtttttaaaacttcgttttcatttgatatttttaggaatttctttcatcgttatgatagagattttatagaaattcaattccctgattcttctacattattaattaaattagatgaagcaaaatgttatgtttattatcctagggcgaaattttttaaagattatcctatgctttagtttttttgtatctaaatttgcattggcatcagtaaatgctccgggtaaatttgatagggttgaagtttatgatgatggcagatatttaggtattcgaggttcagatgacaaaagaagaagaatttggaaaggtgtatttgatagagaatcgggaagatatttaacttcagaagctcaagatttaaaagttaggcatgtatctactggagcatcaagtacgggtaaagttagttcggttgtatcttcatcagtttcccgcgctggcgtattggcgggggtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatagttgcacatttgattggaacggcggagattgtgtggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgttccccctgcccccgcggcgtcgcaagtgagactgggggtgcgggggctagtccccgcaaagcctttcagcttcggaagccacggccgaaaggcaggcgcagcactgccggtctgagcggaagccaggctacaggcaggcgcagcaccgccgagctaggcggaagccaggctacaggcaggcgaagcaccgccggttgggcggaagccacggccgaaaggcagggcgaagcaccgccaggcttaggcggaagccacggccgaaaggcaggcgaagtaccgccggtctgggcggaagccatggtaaaaggcaggcgaagcaccgccgggcttcagtaacctttgttcaggcagggggaggatgtccgtaaagaatcgtaaaggcggggttttttcgcctttatgattctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggatttgagattgcggcatttatcgggagcaacagaagccgctccgccgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaacctacattccgtcattcccacgaaagtgggaatccagttttttgagtttcagtcattcccgataaattgccttagcattgaatgtctagattcccgcctgcgcgggaatgacgggattttaagttggggtcatttattggaaaaagcagaaaccgctccgccgtcattcccacgaaagtgggaatccagttttttgagtttcagtcatttccgataaattgccttagcattgaatgtctagattcccgcctgagcgggaatgacgaatccatccgtacggaaacctgcaccacgtcattcccacgaacctgcatcccgtcattcccacgaaagcgggaatccagttcgttcggtttcgcttgttttaagtttcgggtaacttctacttcgtcattcccgcgcaggcgggaatccagtgcgttgagtttcagctatttagaataaattttgaaactctaatcgcgtcattcccacgaaagtgggaatccagttttttgagtttcagtcatttccgataaattgccttagcattgaatgtctagattcccgcctgcgcgggaatgacgaatccatccatacggaaacctgcaccacgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaaagtgggaatccagctttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagctttttgagtttcagtcattcccgataaattgccttagcattgaatgtctagattcccgcctgcgcgggaatgacgaatccatccatacggaaacctgcaccacgtcattcccacgaacctgcatcccgtcattcccacgaaagtgggaatctagttcgttcggtttcgcttgttttaagtttcgggtaacttccacttcgtcattcccgcgcaggcgggaatccagtttcttgagtttcagtcatttccgataaattgccttagcattgaatgtctagattcccgcctgcgcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacggcggagcggtttctgttttttccggtaaatacccacaagctaaaatcccgttattttcacaaaaacagaaaaccaaaaacagaaacctgaaattcgtcattcccacgaacctacatcccgtcattcccacgaaagtgggaatccagttttttgagtttcagtcatttccgataaattgcctcagcattgaatgtctggattcccgcctgcgcgggaatgacggcggagcggtttctattttttccggtaaatacccacaagctaaaatcctgttattttcacaaaaacagaaaaccaaaaacagaaacctgaaattcgtcattcccgcgcaggcgggaatctggttcgttcggtttcgcttgttttaagtttcgggtaacttccacttcgtcattcccgcgcaggcgggaatccagtgcgttgagtttcagctatttagaataaattttgaaactctaatcccgtcattcccacgaaagtgggaatccagttttttgagtttcagtcattcccgataaattgccttagcattgaatgtctagattcccgcctgcgcgggaatgacggctgcagatgcccgactgtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatactgtaatcagggatgctcagttcgtcgaaacggcaaaacaggttgaagtcgatgcgggtgatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcatgagaaatctcctaaatgtcttggtgggaatttaggggattttggggaattttgcaaaggtctcaacttgagtttcacgccccgcttaacaatattcagttggtaaatattagataaaaccataaaaattaaattgatggcttttataatccccgatttgcgaaaatgccgtctgaaagtcttcattcaggctttcagacggcattttgatcatcaagtaacgctttatcaggcttttttattgttcaacgcagctttgacaaacgcggtgaacaaaggatgccctttgcgcggattggaggtaaactcggggtggaactggcaggcgaagaaccaaggatggttcggcagttcgatggtttcgaccaagcgttcgcgtccggcagatacaccgccgatgaccaaacctgcctgttccagtgtaggaacgtagttgttgttgacttcgtagcggtggcggtggcgttcgcggatatgtccgctgccgtagattttggcggcgaggctgcctgctttcaattcgacttcttgcgcgcccaaacgcatcgtgccgcccaaatcggtggattcgtcgcgggtttcgacgctgccgtcggcagtttgccattcgtcaatcagggcaacgactggcgcggcgcatttgaggtcgaactcggtggaattcgcgcctttcaagcctgccacgtcgcgggcgtattcgatcagcgcaatctgcataccgaggcagatgcccaagtatggcacgttgttttcgcgggcgtagcgcacggcggcgattttgccttccacaccgcgcgaaccgaaaccgccgggaacgaggatggcgtccatgtctttaagcatggaaacgtcgcccttgtttttctcgatgttttcgctgtcgacaaaggtaatctgcacgtcggtttcggtgtgaatgcctgcgtgtttcaaggcttcgatcagcgatttgtaggactcggtcaaatcgacgtatttgccgaccatggcgattttgacggtgtgtttcgggttttggatggcgtggacgatttttttccacgcggtcaaatccgcctgctgcacattaagctgcaactgctcggtaatgatgttgtcgatgccttggtcgtgcagcatttcggggcattcgtagatgctgtccacatcgtagctgccgacaatcgcgcgttcttccacgttgcagaacaaggcgattttgcggcgttcgtccgcaggcattgtcctgtccatacggcaaatcaggatgtcgggttgcaaaccgatgctcaacatttctttaacggtgtgctgggtcggcttggttttgatttcgcctgcggcggcgatgtaggggacgtagctcaagtgggcaaacaaggtgttgttgcgccccaactggcttcgcatctggcggatggcttccaaaaacggcagcgattcgatgtcgccgaccgtgccgccaatttcgacaatcgccacatcgtaacctgccgcgccttcgtggatgcgtcgtttgatttcgtcggtaatgtgcggaatgacttgaaccgtaccgccgaggtagtcgccccgtcgttctttggcgataacgttttcgtacacctgtcccgtgctgaagctgttgcggcgggtcatcgtggaatcgataaagcgttcgtagtgtcccaagtcgaggtcggtttccgcgccgtcgtcggttacgaacacttcgccgtgttggaacgggctcatcgtgccgggatcgacgttgatataaggatcgagcttgagcatggtaacgttcaagccgcgcgattcgaggatggcggcaatagaagcggcggcgatacctttacccagtgaggagacaacgccgccggtgacgaaaatgaatttggtcataatgaaatacccgtattggaatgcgtgattttaacgtgaagcgcgcggttctggcaaacggacggatgccgtctgaacgatggacggctgttttcagacggcatcttttctttatttcccggtactttgccgcaactcgcggcgcaggattttgccgacgttggacttgggcaactcgtcgcggaattcgatatttttcggtactttatatgcggttaattcggtgcggcaaaaagcgataagttcttctttggtcaaagacgggtcttttttgacgacgaatactttgagtgcctcgccggttttttcgtcgggaacgccgatacaggcgacttccatgactttgccgtgatgcgcgatgacttcctcgatttcgttcggataaacattgaatccggaaacaacgacgaggtctttcttacgatcgaccagcttcaaccagcctttttcgtccatgacggcaatatcgccggtttccaagaagccgcgcgcgtctatggctttggcggtttcttcggggcggttccagtagccttgcatcacttgagggccttttacccacaattcgcccggctgcccgacggggacttctttgccgtttgcgtcgcgcagttcgacttcggtggacgagacgggcaaaccgatgctgccgctgtatgattcgatgtttaaggggttgcagcacacgccggggctggcttcggtcagaccgtaggcttcgacgatgggcgtgccggtgatttttttccatttttcggcaacggctttttgggtcgccataccgccgcccaaagtcagccgcaattctgaaaaatcgacttcggcaaaatcaggacggttaaccatcgcgttaaacagcgtgttcacgccgataaatacattaacccgctgttttttcagttctccgataaagcctttcatatcgcgcgggttggtaatcaggatgattttcgagccggcattggcaaaaatcatcagattcacggttaaggcaaaaatatggtacagcggcaaggcggcgataacggtttctttgccctcgcgcaactggtttttaatccattcttttgcctgaagcatattggcgcagatgttgccgtgactcagcaccgcccctttggcaacacctgtcgtgccgcccgtgtattgcaacagcgcggtatcttcgcggtttaatgcgacaggttggaaaacgtgcttcgccccttctttcaatgccgtctgaaaggaaacggtttcccgaatacggtattcgggcaccattttcttgattttccggatgacgaaattgatcagcgaacctttaagcagcccgaacatttcgccgacggaggctacgatgacgtgtttgatctgcgtgcgcggcagcaccagctccagcgtgttggcgaaattttccaaaacgatgatggcggtcgcgccgctgtctttcaactgatgctccagctcgcgcggggtatagagcggattggtgttcaccgctaccaaacctgcctgcaaaatgccgaaaagggcaaccggatattgcagtacattgggcaacattattgccacgcgctctcctcgaggcaatttaaggacgttttgcagataagaagcaaaatctgttgccagtttgccggtttcggcataagtcagcgtcttacccatgttttgaaaagcaggttggtcggcaaatttttccacgctttggcggaatacgtcgctgacggaattgtattgcgtgatgtcgatttcggcactgacgcccttctcgtagctgtctaaccagattttttccataggtatcggtctttaaagtggaattgagcggaacaatgccgtctgaaaaccgtttcagacggcattacctttatcgtgtgatgatgacgggtttgtcggtcgtttggatgataccgccgcccaaacagatatcgccgtcgtacagcacggcggactgacccggcgtaaccgcccattgcggttcgtcaaacaccagctcggcggtttcatcatccaaatagcgcaactcacaaggcgcgtccgccatacggtaacgcgttttgcaggtatagcgtcctgccttcgggcgttcgggcagcgtgaaactcaaatcgttcatcacaaggctgcgggtataaagcagcggatggtcgtgtccttgcacgacaatcagttcgtttttcgtcaaatctttagccgcaacaaaccacggttcgcccgcgccgccaatgcccaaacctttgcgctgtccgagcgtgtagaacatcagcccgacgtgttcgccgacggttttcccttcgggcgtaaccattttaccattgtcggtcggcaggtatttctgcagaaactcgcgaaacgggcgttcgccgatgaaacagatgcccgtgctgtcttttttagcggcggtcggcagtttgaactcggcggcaaggcggcgcacttcgggtttttccaaaccgcccaacggaaaaatcgcgcgctcgagttggaaaggcttgaggcggtagaggaaatagctttggtctttgtttcgatccaaacctttgagcaggtaatgcacgccgttgcgaacttctttgcgcgcatagtggccggtggcgatggtatccgcgccctgccctacggcgtagtccaaaaagcatttgaatttgatttcggcgttgcacaacacatccggattcggcgtgcgccccgcactgtattcctgaagaaaataagcaaagactttgtctttatattgcgcggcgaaattaacgatgtcgatatcgatgccgataatatcggcaacggcgatggcatcgaacgaatcctgtttgatgctgcaatattcgtcgttgtcgtcgtcttcccagttctgcatgaacacaccgcgcacttgataaccctgctgcttgagcagggcggcggttacggaagaatcgacaccgccggagagcccgacgatgatattggaagggtttgctgtcgtattcatgcgtagaatatggttggaaacggcggtttttaaaggcggattttaacacattttaaaggcgggcataaaaatgccgtctgaaagcccgggctttttcagacggcatttcaaacattttcagcagattagtgctgatgcgcttcgccgtggtgatgaccgtggttcattgccggcatcggcgcgattttgacttccagttggacggtttgcgctttggcgtttttaaatttcagggtaacgggaattttatcgccctcttttaattgttttttcaaacccataaacatcacatgatagctgccgggtttgagttcggtaacggatttcgcttccaaaggcacgccgccttcgacttcgcgcatccgcatcacgccgttgtcgttgatgtgggtatgcacttcgacgcggtcggcaacggggctgcttccgccgagcaaaaagtcttgtttggcttcgtcgttgtggattttcatgaacgcgccgcctattttcataccttcgacggtggtgcgcgcccagccgtcctcaacgtggactccggcggcggaaaccgcgcctgccaaacctgccatcatcacggccgccaataattttttcatctttctgctccttataatatcagacggggaatgtgcttaatcttatagcggattaacaaaaaccagtacagcgttgcctcgccttagctcaaagagaacgattctctaaggtgctgaagcaccaagtggatcggttccgtactatttgtactgtctgcggcttcgtcgccttgtcctgatttttgttaatccactatacatacaaatactgcctggaaatttgatgtagattaagtgaataataaataccacatactaatcctaaaggattacaaatcctgctgcaagcgttttacccgaacagggcagacagccaaaccgccgccaacatcagcatcgcgaacaattgtgcggcagaacctgcgtctttggcgagtttggccagctcgtgtttttcggtcgaagtatgatcgacggcagcttcgacggcggtgttgaacagttcgacaatgaccgacacaaaagacgcgataatcaacggcaggcggacggcggtttcggaaacccaaaaaaatgccgcgcacaccagcagtacgttcagccacaaaacctgacggaatgccgcttcgtaacggtaggcggcggcgatgccgtctatcgaatagccgaatgcgttaatgacgcgcctgatgccgcctttgccttttttttctgccgcgtaggaggaaggttccatcggtatcctttcaaaatgttctcaatatagtggattaacaaaaacctgtacggcgttgccccgccttagctcaaagagaacgattctctaaggtgctgaagcaccgagtgaatcggttccgtactatttgtactgtctgcagcttcgccgccttgtcctgatttttgttaatccactatatataccgtctgaaaacggggcggcggggtgtccgtacggtattaagcgtatccctgccggctgagagaaaaccctgcctgcccaatcaaaccaggcggttgtgaagcaaaagcctttcagacggcatcggtttaacgtaccgaccacgcggcaacggcatcggcaaacattgccgccacatcgaaacctttttgtttcataatttcttggaatccggtcgggctggttacgttgacttcggtcaggttgctgccgataacgtccaaaccggccagcaggatgccgcgccgtttgagttcgggggcgagcgtttcggcaatttcgcggtcgcgtccgcccaattcctgcgccacgccgcgcccgcctgccgcaaggttgccgcgtgtttcgccgttttgcgggatacgcgccaaagcataggggacgacttcgccgccgataatcaggatgcgtttgtcaccgtgtacgatttcgggaatgtagcgttgcgccataatggtgcgggaatcaagctgcatcagggtttcgaggatgctgccgatgttggggtctttttcggtcaggcggaaaattcccataccgcccatgccgtcgagcggtttgatgatgatgtcgccgtgttctttcaaaaatgtgcggacatcggcggaacgggtcgttaccagcgtgggcgcgataaagcggctgaagttcaaaatcgccagtttttcattaaagtcgcgcatcgcctgtccgctgttaaagaccttcgcgccctgctgttccgccagcgtcagtaattgggtggcgtagaggtattgcatatcgaacggcggatcggtacgcataatcacggcatcaaatgcttccaatgccgtctgaactttgtcggcagatttgaaccacgcatgatcatcatcgttttttgcacccaaaaattcaaatgccgatgcctgcgccgttaccaaaccgccgtttacagacaattccccgctcaatgtgtgaaacagccgccagccgcgttttgccatttcgcgcatcatcgcgtaggtggtgtctttataggttttgaaacttgccatcgggtcggcgataaagaggactttcatcatatttcctttccggtgtgccgaatgtgccgcatttcgcgggtaaaggagaaattccgcccgaacaatattcagacggcagggatggggttttacttaggctgccaagagtctttcagcgttaccgtgcggttaaacaccggcgtgtctttgccgtggtctttacggtcggttacgaagtagccgatacgctcgaactgccaacggctttctgccggcaaatctttggcggcaggttcggcgtaggcggtgatttccttgacggattccggattgaggaaatcggtgaacggcaggtattcgccgtcttcgccgcgcacggcatcgggacgctcgacggtaaagaggcggtcgtacagacggactttgatttcggcggcgtgttcggcggaaacccaatgaatcacgcctttaactttacggccttctggatttttgcccaaggtgtcgtggtcgatgctgcatttgagttcaaccacattgcctgcttcgtctttgacgacttcatcgcacttgatgacatagccgtggcgcaagcgtacttcgccgccgggaatcaggcgtttgaagcctttgggcggattttcggcaaagtcgtcggcttcaatatagatggtttgggaaataggtacttcgcgctcgcccatttcctcgtggttcggatggaacgcggcacggcggctttgggttctgccggtttcaaagttggtcagggtcactttgagcgggttcaacaccgccatcaggcgtggggcggaattttccaactcttcgcgaatcgcgccttccaacacgctcatatcgacgatgttttcagatttggaaataccggcgcgtttggcaaacaggcgcagcccttcgggcgtgtagccgcgtcggcgcataccggaaatggtcggcatacgcggatcgtcccagccggaaacgtgtttttccacaaccaactgattcaatttccgtttggaggtaatggtgtacaaaagctccaaacgggaaaactcgtattggcgcggacgggtggcatgcggcgcaggaatgttgtccaacacacagtcgtacagcggacggtgtgcttcgaattcgagcgtacacaaggaatgcgtgatgccttcgatggcatcggagatgcaatgcgtgtagtcgtacatcgggtagatacaccatttgtcgccggtgttgtggtgatgggcgcggcggatgcggtagatgacggggtcgcgcatattgatgttgcccgatgccatgtcgattttcaggcgcagggttttgctgccgtcggggaactcgccgtttttcatgcgtgtgaacaggtcgaggttttcttcgacgctgcggtcgcggtaagggctgtttttacccgcttcggtcagcgtaccgcggtattcgcgcatttcttcgggcgtcaaatcatcgacatacgctttgccgtctttaatcaaaccgacggcgtagtcataaagctggtcgaaatagttggaagcgaaacgcggctcgcccgcccaatggaaaccgagccactcgacatcttctttgatggcgttgacgtattcgtcgttttctttttcggggttggtatcgtcaaaacgcaggttgcacaagccgtcgtaaatatacgccaaaccgaagttcaggcagatggatttggcgtgtccgatgtgcaggtagccgttgggttcgggcgggaaacgggtttggacagctgtatgtttgccgctttcgaggtcttcttcgatgatggtgcggataaaatggttgtccgcaaattggtctttattgagcatagttttctttgaacagatggcttcagacggcattggaatgattccgtatgccgtctgaagcggtttgggaatgtgtttattgtacccgacttgcgcgctttgacatagcgttcagacggcatcggcaatcaagcattccacccccgcctctttcagcatcttctgcatcgcggtatcgggcagccggtcggtaaatactttgtcaaacgccgtaatgtcgccgagcctgaccagcgcgttgctgcggaatttactgtggtccacgccgaggaagcggacgcgcgcattggcaatcatcgcctgcatcacgctgacttctttgtagtcgtcgtccaaaagcgaaccgtcgctttccacgccgtgcgtactcatcacggcataatcgactttgaactggttgataaaatcgacggttgccacgccggtaataccgccgtccaaagggcggacgactccggaagtgatgatgaccgtataatccgtccgcgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgcctccttgcatcgggatgccgattttaccgcgttcaacccaaagcggaaaacaccaccatcagaaacggggcggcgatattgaccaccacgccgaagctgaccgctaccggcacgacttccaaaccgcccgcaccctgaatcacgggcaatgtaaaatccatactggtcgcaccgccaacccccaccgccgcatctggaaaacgcttcatcagcagcgggataaatgccagtgcaaacagctctcgtgccaaatcgttcagcagcatgatgctgccccataccgcgccgtaagcctcggtcatgaccaaacccgagagggaataccaaccgaagccggaagccatcgccaaacctttcgtccacgacacaccgtctgtcgatgcggcaaacagcagcccgcccgaaagagatgaaagcataaaccagaccgacaaccgaatacccctgcggttgaccaaaacctgccgcaacgatacgccgctgcttttgagctgtacgccgatgaggaacaccagcagcatcagacaatacatgcccgcgctttcagacggcatccaaatatcgcgcatcagtttgccgaatgcaaatccgagcagcacgcatccgagctgccccacactgcccgacacgccgaccgaaacgcccttccctttcccctttatccgccacgggaataactttcccaacactgccaaagcaagcaggttcgccccgaccgtacaaacaaacagccacagaaccgtcaacgccatatcgtccaaccgcgaacccaaatcctccacgcgcgacaacgagacgccgatcagcagcagcacagcatacaccaagaccgatagcaccttatccaaagcgggcaggtaaggcttgggcacacggataaaaaatccggcaaacatcggtatcaataccgaaagcaacgtcatcaggctgtccatctactgctctcctttattgccgcatgatatgtgcggtttaaaaattgccgtctgaaaattgcagatacccgcatccatatttcagacggcatcaggttcgccattaaaaaaccgcctgaaggttcaggcggcttatccgctccggcattcaatcttccaaagtcttttccaaacgctccatacagttgcccaaatggcggcgcaggattttgaccacgcggttgcgcctgcccgccagcagcaggtcgaggatttcgcggtgttcggaatgcgtatgcgtattgatggcgtgtttttcctcgcgatgcacgcccgccacggcgacaatcagggaagaccgcgcgcacagcgtattcataatgtcgaacagcacatcgttgcccaccaggcgcgccagttcgacgtggaaggcattggacaggcggttccagccgacgcggtcgcccctgccggaggcctcttcttcgcgccgtatcatcgcataaagcggcttgaggcgcgtttccaaatccggcaaatctgcgaggatattcaaaatcatcgtctccatttcgatgcgcgcattgaacacatcctgcatttctttcaaatcgggaacgtggacgaacgcgcccctgttgggttgcaaatcgacaatcttgtcgtgcgccaaaagcgacagcgcgccgcggacggtgttgcgcgaacacaccatctgacggcaaagttcggattcggtcagctttttgccgggcagcagcacctgatcggtaatgccgtccaaaatcagggcgtaaacacggaacagctccgaatcgtgccgctcttcgagaatcagggaagacgtggtcggcgcatggataatgtcgtcgttttcaaagttcatgatgttttccgtatttttacgctttcaaattttttaagatgttttaaggcggctgtgtttcaaatcgtgtcagaggaattaaagcattgcacaaatttattttatagtggattaacaaaaatcaggacaaggcgacgaagccgcagacagtacaaatagtacggaaccgattcacttggtgcttcagcaccttagagaatcgttctctttgagccaaggcgaggcaacgccgtactggtttttgttaatccactataattcaataaattaatatatggcttaaaataacgggattctcgcctcccgcccgcccgcagaagcaggcggatatcattttaaaacgcggcatttaaaatttgaccgaaaattgttgacaatccggaatcaagtctgcacaataccccgacaagtccaagtattataaaggctgaataaagaggaaacagcaggcagatatattcgggaggtgcagtccgaatatatctgcttttttatgcgcctccggattgcctgccgcacctttcccttcagacggtatcagccgtttccccataatgccgcccgatgcctatttatctgccccggcaatttcaaaactgtgggtaatctttgccgctttgcccaacataatcgaagccgaacagtatttttcggcagacatctgaacggcgcgctcaatggccgattctttcaaatcatgcccgaatactttgaaatggatgtggatttcggtaaacacgcgcggcgcatcgtccgcccgtttcgccgtaaccgtcgcacggcagtcagtcactttctgacgctgtttttcggcaatcatcaccacatcgatgctcgaacagcccgccacgcccaacagcagcatttccaaagggctgggcccgcgcttagccttaccttctgccgccgacccctccataacgacgctgtgcccgccttccgtcgtgccgacaaaacacatcccgtctatccattttgatgtaacctgcatggtgtcattcctgaaaatagcgttaaaaccgctttgcatatggcgttattgtaaacaatttcaagcggcttatgcagaaatatggacaaaacggcaaaaaaacacttgaaaaccgatttacggtttggctgcctggccgttgatctgcaccgatttgagtttcagcgtataggttttgccgtcgtcggtatagccgatttgtgccggaatattgttcagggacggtgcgaagaaatacattaccgcatcgtcgccgcgccgcacccgatatttgacgacttcggtttccacgccgcctatgctgtattttcctgtacccgccttattcaaaccgccgacggaataaagttttttgccgttggtgattttcagccccggggggagtttcgcgtcatttgccgccaactgccaggcaagcgtgaacaaatccatagccttggggctttgctcggttttgctctcgcccgctttgccgtaagttacgctgccgtcggcgaatttggcttccgcatacagtttgcccctgcgtatgtctctatagtaggtagggtgcagggtattgccgacaaccgtaccgccggactcgaaacggatattgtatagcggcactttaatcgtcgaaacgattttgtaagcattgccgctgcgttcaaatgtcatcgtggcgggaatgccgtagctgccggaatagtgcagcacggcggattggggcagccctgccgcatacgcgcacggcagggcggcggacaaaatggcggcggaaaatatatttttaaaagtcttcatcatttgctcccgcccggtttacgccgtcagaaaacgggcggcatcggcgttttccgaatttctgacgcggtttccctcaataatcaggcggccggcggcaaaatcggcaacggctttcggataaagtttatgctcgacagccaaaacccgtgcggcaatatcgtctgccgtatcgccgtcgagtatcggcacaaccccttgcgatacaatcgggccgcaatccagttcggcagtaacgaaatggatggtgcagccggcaacgcggcagcccgcctccaaagcgcgttcgtgcgtatgaagtccggtaaacgagggaaggatggacgggtgaatgttcatcagcctgccttcgtaacgggcgcaaaactcgggggtcagaatccgcataaaacctgccaaaaccaccaagtcgggttgatatgcgtcgattttctccatcatggcggtatcgaaggcaagccgggatgtaaagtttttatgattcaggctatcggtcgggatgccgcgttcggccgcccattgcaaaccggcagccgtttcgctgttgctcaacacggcggcaatgcggacgttgtgaatggcggcattgacgattgcctgcatattgctgccgcgtccagaaatcaggatgacgatgtttttcataatggtgcgcttttgaaagggatgccgtctgaaccgctgtttggtggtttcagacggcatttgccgtaaaaatgcccgaaaacctgtttcgggcatggattcggacttaatttacttttttgatgtcgacttgagccggctgcttggcgggcgcgttttcgggtgcgccgattttgaccagtttcacatcaaataccaaagtggcgttcggaccgattttgtcgcccgcaccctgttcgcggtaggcaaggttggacgggatgtagaacgtggcttcgccgccttctttcagaagctgtacgccttcggtccaacccggaatcacttggctcaaagggaaggtgaccgggccgccgttggctttgctgctgtcgaataccgtaccgtcaatcaggcggccttcgtattccacggtaacgatgtcgtctttggtcggctgtttgccttcgccctgtttggtgattttgtattgcaggccggaagcagtggtcttcacgccgtctttggcggcattttctttcagaaaggcttcgcctttttctttattggccttcgcgtccgccttgtgtttttctacggctttagcctgttgttcctgaaggaatttcatcatgacttcctgagcctgctcttcggtcattttgatttctttgccgtcatacactgcctgcatggcttcggtaaagactttcaaatcgatttccgcgccctgttccttcatttgcttcagggagcgtccgatgtccacgcccatcgcatagcttgcctgctgcatcgtgctgccgatcgaagaggtgtcgccctgcgcggaagaagcggcggcaggttcggatgcagatgcgggggcggcttcttttttgccgcaggcggaaagtgccaaagcggcggaaagggtcagtgcgctgattttgaaaatggtgttcatgatggatcttcgctgtcgataaggtcggaaaaacgggattatagccgagtttgaatgtttcaacacacaggatgacacataaagcgtcaatcgtgtgttgccctgttttggaagggattgaaccttccaaaataagttttgattctaccgccccgagggacagatgtccaagtggcggggttcaaccgataaggaaattttaatcaaatagaatcaagcctgtttaaattttgtaaatgcggcatttcagacggcattttatgccttgccctccatgccgtgatgttcgatggcaaaaccgcttcggcggtaggcggtaaagcgttcgcgcgcgtcggcgagctcttccaagctgttgccgacgatttccaaaacgcgcgcgggcaagaccggagcggtgttccaaaaaccgtcggacaggttcaaaacggtcatgccttcgggaattcggggcagattgccgccgcaggcaagcaggacggatggttcagacggcatggcttcttccgtttcccaaatttcgtgcggaatgaaactctcggcctcgtattgccaaagcattttgtccaattcctgaagctgcccgaacgaatcggaccacaccagtatcctgccgccgtcccgaatcgcacgggcaatcaggcggcaggtgaaaatcggaacttgggcaacgtgcgtgtaaaaggtggctttcggcatattgtttgaacatttggcaggataatgccgtctgaaaggcttcagacggcattgtgggaaaattaaagattccgcagatagttcagcagcaagggaacgggacggccggtcgcacctttttccgcaccggatttccacgccgtacccgcgatgtcaaggtgtgcccatggatagtcttcggtaaagtaggataggaatgttgcggcggtaatcgtgcccgcgccgggcgtgccgatgtttggaatgtcggcaaagttggatttgagttggtctttgtaggtctcaaagagcggcagttgccatgctttgtcgtccacgttgtagaagcggcaagcaggctgtcgatcaaatcctgattgttgcccatcacgccgctgacatcgtgccccaaggcaacaatacacgcgccggtcagggtggcgacgtcgatgacggctttgggtttgaactgctcggcgtaagtgagcgcgtcgcacaaaatcagacggccttcggcatcggtgttcaacacttcgatggtcagccctttcatacttttcacgacatcgcccggtttgtttgccgcgccggaaggcatattttcacaagtggcgacgacggcaatcaggttaatcggcagttgcagtttgacggcggcgcagaaggtgctgatgacggttgccgctccgcacatatcaaacttcatttcgtccatgttcaggccgggcttgagggagatgccgccggtgtcgaaggtaatgcctttgccgaccaataccacaggcgcggcttctttgtcggctgcaccgaaatagctcagttcgaccaaatagggggcttccgcgctgcctttggcgaccgaccaaaacgaacccatgttttctttgatgtagtctttttcgatgattttggcgtgcgcgcccagtttttcggcttcggctttggcggtgcgcgctaaaaattcgggcgtgcattcgttgggcgcggcgttgcccaagtcgcggcagaggctttgtccgtaaacttgcgcttcggcgacgcgcaaggcttctttgacggcggcttcgtgcgcggtatggaacacggcagtttcaaatttggcgggcttggcttcttttttgtagcggtcgaaacggtaggcggcattgccgaacgcaatcgcaaacgcttcggcaacggctgcagcctgcgcttcttcaaagacgtgaacgtccacattgaccgtttcctgattttgcgcccatttggcggcttcggcggcggccttgttcaatgcggcgcggccggtgcttttcagacagcatacggcaacagcctgcaaaccgttgcctgtcgggatttttgtgtcggcaaaattttgaccttcttcaagcgaagacaaaagggcaaggacggtcgggttgctcagttgcgatgcttcggtgcagacaaataactgtgcgcctgcctgctgttcctgcaagatttcggtttttgtgctaaattccacgtttattctcctgattgagacggttgtcggtagttttcggacggcctttcgctcaaaagaccgtctgaagacggctggcacgattgtaccccatttgaagcaccgtctgaaaccttgcgcggacaatccgcctgcgccgaaccgcttaccgcccccctgaccgcgattctatgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcattatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtctcggattgctgttccaccttgccggacggctcttcgggtttaccagccaactctacggcatcccgcccttcctcgccggcgcactacctaccatagccttcgccttgctcgccgtttggctgatacgcaaacaggaaaaacgttgaaccaatgccgtctgaacctctcttcagacggcatttgttttcattgacacattcccacagacagatagccgttccctattacattacctgtcataacagttccatttttgttaaaactagtctatgatagcggtacaaatattgtttacaatatttaacgcaaatcatttgcaacccgacaaaagaaaaacagaaaaaggaacaaagagatgttagaagcctatcgtaaagccgccgccgagcgcgccgccctcggcattcccgccctccctttgaacgcgcagcaaaccgccgatttggttgagctgctgaaaagcccgcccgcaggcgaaggcgagttcttggtcgaactgcttgcccaccgtgttccgcccggtgtggacgatgccgccaaagtcaaagcctcattcctggctgccgttgccgaaggcagcgcgtccagcccgctgatctcccccgaatatgcgaccgaactcttaggtacaatgctcggcggttacaatattcacgccttaatcgaactcttggacgacgacaaactcgcgtccattgctgccaaaggcttgaaacatacgcttctgatgttcgattccttccacgacgttcaagaaaaagccgaaaaaggcaacaaatacgcgcaagaagttttgcaatcttgggcagatgccgaatggttcgcctcacgcgccaaagttcccgaaaaaatcaccgttaccgttttcaaagttgacggcgaaaccaatacagacgacctctcccccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcttacgtcggcgacgtggtcggtactggttcttcacgcaaatccgcgaccaactccgtcatttggcataccggcgaagacattccgttcgtgccgaacaaacgcttcggcggcgtatgtttgggcggcaaaatcgcgccgattttcttcaatacccaagaagattccggcgcgctgccgattgaagtcgatgtatctgctctaaaaatgggcgatgtcgtcgatatcctgccttatgaaggcaaaatcgtgaaaaacggcgagactgttgccgagtttgaattgaaatcacaagtattgctggacgaagtgcaagccggcggccgtatcaacctgattatcggccgaggtctgaccgccaaagcgcgcgaagccctgaaactgcctgcctctactgcattccgcctgccgcaagcgcctgccgaaagcaaagccggtttcaccttggcgcaaaaaatggtcggccgcgcctgcggtctgcccgaaggacaaggcgtgcgcccgggtacttactgcgaaccgcgtatgacgacggtcggctcgcaagacacgaccggcccgatgacccgcgacgagttgaaagacttggcttgtttgggcttctccgccgatatggtgatgcagtctttctgccacaccgccgcctatccgaaacctgtcgatgtaaaaacccataaagaactgcccgcctttatttccacccgtggcggcgtgtcactgcgtccgggcgacggcgtcatccactcgtggctcaaccgcctgctgctgcccgataccgtcggcaccggcggcgacagccatacccgtttccccatcggtatttccttccccgccggctccggcttggttgcctttgccgccgcaacgggcgtaatgccgctcgatatgcccgagtctgtattggtacgcttcagcggcaagctgcaaccgggcgtaaccctgcgcgatttggtgaacgccatcccgctgtacgcaatcaaacaaggtttgctgaccgttgccaaagccggtaagaaaaacatcttctccggccgcatcctcgaaatcgaaggcctgcctgatttgaaagtggaacaagcctttgaattgaccgacgcatccgccgaacgctccgccgccggctgtaccgtgaagctcaacaaagagccgattatcgagtacatgaaatccaacgtcgtgttgatgaaaaacatgattgccaacggctatcaagacccgcgcactttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtgtgcttcatgtccgaacgctccggcaccaaaatcgacgaagtattcatcggttcgtgtatgaccaacatcggccacttccgcgccgcctccaaacttttggaaggcaaggcagacacccccgtccgcctgtggattgcgccgccgaccaaaatggacgcgaaacaattgtccgacgaaggacactacggcgtactcggacgtgccggcgcgcgtatggaaatgccgggttgctccttatgtatgggtaatcaggcgcaagtacgcgaaggtgcgaccgttatgtccacctccacccgcaacttcccgaaccgtttgggtaaaaacacctttgtttacctcggttcggcggaattggcagcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaacgtttaatccccgtcatccgtatgaagtaagggattgaccgcaatgccgtctgaacaaccttcagacggcattgcaacattccgctaacccttctttccgcaaacgctgcaaatacggcgttcacgcccccacataaaggaaacgacagtgaacctgaaaaaccgccattttctgaaacttttagacttcacgccggaagaaatcaccgcctacctcgaccttgccgccgaattgaaagccgccaaaaaagcagggcgcgagattcagcggatgaaagggaaaaacatcgccctgatttttgaaaaaacctctactcggacgcgctgcgcgtttgaagtcgccgcgcgcgatcaaggcgcgggagtgacttatttagagccgtccgccagccaaatcgggcataaggaaagcatcaaagacaccgcccgcgtgttgggcaggatgtacgatgccatcgaatatcgcggtttcggtcaggaagttgttgaagaattggcgaaatacgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcaccgcaaagcctgtggccgtctgaaggcattattgccgccgcacacgccgccgccaaagaaaccggcgcaaaaattaccctgaccgaaaacgcgcatgaagccgtgaagaatgttgattttattcataccgatgtgtgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaaatattcgaaagccccgccagcatcgtgttcgatcaggcggaaaaccgtatgcacacgattaaagcggtaatggtcgcggctctgggcgactgacagaactgtgcctgtttaaattcatccgcaacacagataccgtctgaacacgatgttcagacggtatccatatatagtggattaaatttaaaccagtacggcgttgcctcgccttgccgtactatttgtactgtctgcggcttcgtcgccttgtcctgatttttgttaatccactataaaaaaactgcctacacgatgtgtaggtagtcccgtttgaaaacaatcagtttttgtcttggtcaaccaatttgttggcagtaatccaaggcatcatggcacgcagttgtgcgccgactttttcaacttggtggtcggcattcagacggcggcgggcagtcatagacgcatagttgacattaccctcttggataaacatttttgcgtattcgccggtttgaatgcgtttcagggcattgcgcatggcttctttgctggaagcattgaccacttcagggccggtaacgtattcgccgtactccgcattgttggaaatggagtagttcatattggcaataccgccttcgaaaatcaggtcaacgatcagtttcatttcgtgcagacattcgaagtaagccatttcaggcgcgtaaccggcttcggtcagggtttcaaaacccgccttgatcaactcgaccacgccgccgcacaatacggcttgttcgccgaacagatcggtttcggtttcttcgcggaaagtggtttcaatcacaccgcctttggtgccgccgttggcagccgcataagacagggcgatgtctttggctttgccggaattgtcttggtaaacggcaatcagagaaggcacgccgccgccgcgtttgtattcactgcgtacggtatggcccggacctttgggggcaaccataatcacgtccaagtcggcacgcggaacgatttggttgtagtgcacgttgaagccgtgtgcaaatgccagcgttgcgccttctttcaaattggctgtaacttcggcgtgatagacggcaggcatggtttcgtcaggcagcagcagcataacgacatcggcttctttggtcgcttcagcaacggttttgacgacatgaccggctgcttcggcttttttccaagaagaaccttggcgcagaccaatcaccacgtttacacccgaatctttcaggttggcggcatgggcatgaccttgcgaaccgtaaccgatgatggcaacggttttgcctttgattagggacagatcggcatctttatcgtaatagacttgcatttgatttcctttaaggtaaatggttgtcgaagccttaaaatgttgagcggcttcggacgggttaaacagagtgtgccgcttaatcggcaacttcattcatcaatacgatttccaacgcttcggttttgccgtcgacggactggacgaaggcttggaaatgcgcgctggcgttatgttcgtcaatagctgcttgagatttccaattttccacgaaaacaaaacggttcggtttgccgatttcctgatggagatcgtagctgatgttgccctcttctgcacggctggctttgaccagttctttaaactgtgctgccagtgtttctgtgtattccggtttgacggtaaccagtgcgacaattttaatgttcgacataaatctctcctgccgttcgtttttcagacgacattcaaataccgtgccgtctgaaaggttacggcgttaaattttcaaaatacgctcaccgcgaccgatgccggccgcgcctgtgcgtacggtttccaaaatttgggcgcgtccgaccgtttccaaaaaggaatccagcttgtctgtcgagccggtaatttcaatcgtatagctgcggtcggttacgtcgatgatgctgccccggtagatttcggtcaagcgtaaaaattcgtcgcggtctttgccggcggcacggacttttaccaacatcagttcgcgttcgacaaaacggctttcattcaaatcgaccactttaatcacttcaatcaatttattgagttgcttggtaatttgttcgatgacctgctcgtcgccgtgggtaacgatggtcatccgtgacagggttttgtcttcggtcggcgcaaccgccaaagaatcgatattgtaatcgcgtgcagagaacaaaccgaccacgcggctcatcgcacctgattcgttttcaatcagaacagataagatatgtcgcatttgtctctccttacgcctttccgtccgcacgcatatgcggcggaagtaccatttcgtccaaacctttgccgttgccgaccatgggcatcacattctgtttctggtcggtcaggaagtcgataaacaccagcctgtctttttggttcaatgcttccaacaacgcaccttccacatcagacttcttgtccacgcggataccgatatggccgtatgcctcggcaagtttgacgaaatcgggcaaagaatcgaaataggtttccgactctcgtccgccgtaatatatttcctgccactggcgtaccataccgagataaccgttgttcagcgtaatgacgttaaccggaatccgatattggaaacaggtggacagctcttggatgttcatctggatcgagccgtcgccggtgatacagaatacgtcttgatccggggcggcaagttttgcaccaatcgcataaggcagacccacgcccatcgtacccaaaccgccggaattgagccattggcgcggacgttcgaagggataatattgagccgcaaacatttgatgctgccctacatccgatgtgatgattgccgaattgccggtaatctcggcaagcttctgaatcacatattgtggcttgataatttcgctgccgttgtcaaaccacaagcaatctcgggaacgccattcctctatggttttccaccatttgcccaaagcatcttcagacggcacggactcttgtttttgccacagcgcaaccatctcggacaaaacgtttttcacgtcgccgacaatcggaatgtccaccttcacgcgtttggcgatgctggaaggatcgacatcgatatggataaccttcttcgccttctcgaaaaatttggacggtacggaaaccacacggtcgtcaaaacgcgcacctacggcaagaacgacatccgcattctgcatggcaaggtttgcctcgtaagtaccgtgcataccgagcataccgaggaattggcggtcgccggaaggataagcgcccaagcccatcagcgtacccgtgcacggagcacccgtcattcggacaaatcgggtcagctcttcagaagcattacccaacaccacgccgccgccaaaatagacgaccggacgtttggcagatgccaacatctgcacggcctttttaatctgaccgatatgtccttgaacaaccggttgatacgaacggataaaaatgtcttcctgaggatagctgaatttcgccatcgcctgcgtaacatctttcgggacatcaaccaccacgggccccggtcggccgcttgcggcaatttggaacgcctttttaatggtttccgccaactcattgatgtccgtaaccaggaaattgtgtttgacgcacggacgggtaatacccaccgtatcaacttcttggaacgcatccgtaccaatcagggaattgcctacctgcccgctgatgaccaccatcggaatcgaatccgtataggcagtagcaataccggtcagtgcattggtaacgcccgggccggatgtaaccaatgccacgcccaccttaccgctgacgcgcgcatacgcatctgccgcgtgtactgccgcctgctcatggcgggtaagaatgtgtttgaatttattgagttggaaaagggcatcgtagatttcgataaccgcaccgccgggataaccgaaaacgtactcgacaccttcggctttgagactctgcactatgatttgcgcgcctgataactgcataacgacctcttttatacggtttcaaaccaatagggacaaaccgctttgccacagcacctgtaatgcaattccaccaagcagcgatttagggtacgcgcattgggggaacacggcaacagacggattatccaatcaattggaaaggaacacagagtttgtgaaaaagagtagaaacgataacgcaaaccgacagttcaatcaagaaaaatctttcatcttttaatattttttgaaagcagagaaattattgattgattttaaaagaataaaatcaggagtaccttttttgaaagatggaaattgttgacagtttgtgtaggaggggcagatgtgaaaaacccttcttcgatatcaagaattgtaaaatttacagggtttcatcccaataaagactcgggatattgattgaacttgattttatttttgatatatcaaaaatattcccaaccatacttcctgaaaatggctcattgcaccggactgtattggacggcattgacagaaccaagagggctaacaacgacttaatatattgattgtatagtggattaacaaaaatcaggacaaggcgacgaagctgcagacagtacaaatagtacggaaccgattcacttggtgcttcagcaccttagagaatcgttctctttgagctaaggcgaggcaacgccgtactggtttaaatttaatccactatatttagttttatctatttcattaaacagcaatagacaaaaaaaataaccgctctaaaagcggttgtggtgcccagggtcggactcgaaccgacacaccttgcggcgggggattttgagtcccctgcgtctaccaatttcgccacctgggctggtgaagaagtcgtcattataatggcttttgaaattctgtaaaccttttttttgaaattattttatctgtttttattttatttttgattttaaatagaatttttattattttaatcttactgttctttccgctccaaagattctgtatgattcggcaattcctgccgtgcagacaacgtaaaaaaatactacattaaatctgccaaacgcgttaagatggaaatattcaaattccgtacgaatcaggttttgctatttattcttgggagattgtcatgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctgataaaaccgtatgccgtctgcaccgtcggcgcctattcagacggcattattgtttcaaccgacaaaggacatccacaccatgcaggataatgctttgaccatcgccttatccaaggggcgcatttttgaggagacgctgccgctgcttgccgctgccggcattgttccgactgaagagcctgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagcagcttcgcaacccggatgccgtctgaagattgccacaaagtatcctgaaatcgcggcatctcattttgccggcaagggtgtccatgtggacattatcaaactgtacggctcgatggaacttgcgccgctggtcggcttgagcgatgcgattgtggacttggtttcgacgggcaacaccttgaaggcaaacggcttggaagcagtcgaacacatcgtcgacatttccagccgcctggtggtcaacaaggctgctttgaaaacgaaatacgcgctgctggagccgattattcaggcgttcggcggcgcagtgaaggcgaagtaagcatccatttgaataaagatgcgttttcagacgaccctatccgttcccgccgacaggtcgtctgaaaatatcaccggcagtaaactgtataggagaagttaaaatggttgcaaaaataaaaaaattctcagattcaaccctttccgttttgaataacggcgagcgtcggttttatgtctattgtctgaccgacctgaaaaaagacaaaatcctctacatcggcaaaggctgcggtaatcgtatcttcgagcatgaatgggttgctagtcgttcacaagatccagtctccggcgagattatcgatcggaaactcaaagccatctccaaatgcaagaaactcggtcgctatatcatcagctatcatctgactgaagtcgaagcactcgccgccgaatctgccttaattcattttgttaaatctgtcttgggtaaaaaactcaaaaataaaattgccgggcatggtccgggtggtattagcgtagaagaactagatcgccgctttggattctcttctctcccacttaacgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcatacgaagtggacggttttgaaacaatggttgaggaaaccaaaaacggtagaaaacaatcccgttaccgtttccgcactacctctcgtagcgaagaggtattagccaaactcggtctgcaacaaaaatgcctgcccgaattgaagtttggtagcgggggagaaaaagcgtatatcagacccaaaacagagacagaaactgaacaagagaatattcagacgacccccaatccaaaaataaaaaaggaaaaaaccaaatcatgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattccgaacgacgttcagacggcattgcagaccgccgcccgccgtgtcgaaagctaccaccaacgccaaaaaatggaatcgtggagctacaccgatgaagacggcacgctgttgggacaacaaatcacaccgcttgaccgcgtcggcatttacgtccccggcggcaaggcggcgtatccgagttccgtcatcatgaacgccatgcccgcccacgtcgcaggtgtgaaagaaatcatcatggtcgtgccgacaccaaaaggcgaacgcaacgacatcgtacttgccgccgcatacgtcgccggcgtaaccaaagtcttcaccgtcggcggcgcgcaggcggttgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatcctggtcatcgccgacggcacgacacctgccgattgggtggcgatggatttgttcagccaggccgaacacgacgaaattgcccaagccatcctcatcggcacgtcgcaagcgtatctcgacgaagtagaagccgctatggaccgcctgatcgaaactatgccgcgccgcgacatcatcgaagcctcgctcggcaacaggggcgcgatgatactcgccaaagacttggacgaagcctgcgaaatcgccaactacatttcccccgaacacttggaactgtcagtcgaaaacccgcaggaatgggcgaaaaaaatccgccacgccggtgcgattttcatgggacgctacaccggcgaaagcctcggcgactactgcgccggtccaaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcccgcgcggcagagttccgtatgaaataatgccgaaacggcgtacaggcatattccaaccattaaggaaacacgatgaaatccgtccgctccttcatccgcgacgacatacaagctatgtcggcatatcagattgccgacgttccgcccggctttgccaaactcgattcgatggaaagtcccgtccacccttttgccggacatgaaacgctgttgcaggaatggcaggcacggcttgccgccgcgcccatccatctttaccccaatccctccggcagcggtttacaggaagcattacgttcggcgttcgacattcccgactgcgccgacatcgcgctgggcaacggttcggacgaactgatacagttcatcacgatgctgaccgccaaaccgggcgcggcaatgttggcagccgaacccagtttcgtcatgtaccgccacaacgccgcgctgtacggcatggattatgtcggcgttccactgaacggagatttcaccctcaacctgcccgccgtcctcgaagccgtcaggaaacaccgccctgccctgacctttatcgcctaccccaacaaccccaccggcgtatgcttcacgcgtgccgaaatcgaagccgtcatcgaagcttcagacggcatcgtcgtcgtcgatgaagcctacggcgcattcaacggcgacagcttcctgccgcaggcaggcaggattcccaacctgatagtcttacgcaccctcagcaaaatcggttttgccggactgcgtatcggttatgcggcaggctgccccgaagtcatcggcgaactgcaaaaaatcctgccgccctacaatatgaaccaattgagcctgaccactgccaaactcgccctgcggcactacggcattatctctgccaacatcgacagcctgaaaaacgaacgcgaacggatgttcgccgaattgggcaaaatatgccgtctgaacaccttttcaagtcaggcaaacttcattaccatacgcgtacccgatgccgatttgttgtttgacacgctcaaacaaaaccgcatcttggttaaaaaactgcatggcgcgcacccgcttttggaacactgcctgcgcattaccgtaggcagccccgcacaaaacgatgccgttctcaacatcattcgccaactttactgccaaccaacggatttcctatgaatttgactaaaacacaacgccaactgcacaactttctgaccctcgcccaagaagcaggttcgctgtccaagctcgccaaactctgcggctaccgtacccccgtcgcactctacaaactcaaacaacgccttgaaaagcaggcagaagacccagatgcacgcggcatccgtcccagcctgatggcaaaactcgaaaaacacaccggcaaacccaaaggctggctcgacagaaaacaccgcgaacgcactgtccccgaaaccgccgcagaaagcaccggaactgccgaaacccaaattgccgaaaccgcatctgctgccggctgccgcagcgttaccgtcaaccgcaatacctgcgaaacccaaatcaccgtctccatcaacctcgacggcagcggcaaaagcaggctggataccggcgtacccttcctcgaacacatgatcgatcaaatcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcgcactaatcggacgtttcgatgtcgatttgtttgaagaatttttccacggcatcgtcaaccacagtatgatgaccctgcacatcgacaacctcagcggcaaaaacgcccaccatcaggcggaaaccgtattcaaagccttcgggcgcgccctgcgtatggcagtcgaacacgacccgcgcatggcaggacagaccccctcgaccaaaggcacgctgaccgcataaaaaaccataccgtctgaaacacccgcaggcttttcagacggtatcggaacagataagattacactacactacaaacagaaaaggagtaaacatcatgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcgrctcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactgattgccttttccaaacacaatgccgtctgaacatatttcagacggcatttttatcaccccacgcttaaaatcagtcccgattatgactatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatccgcacaaatttagtcaatatcaagaccaattatgaaccaactcgaccaacttggcacccgtatcaacctgatttgcaatgtcttcgacaaatggatcgggcagcaggatctgaattacaacctctttgccgtactttataccctggcaaccgaaggcagccgcacgcaaaagcatatcggcgaaaagtggagcctgcccaaacagaccgtttcaggcgtatgcaaaacccttgccggacaagggttgattgaatggcaggaaggcgaacaggaccggcgcaaacggttgctgtcgttgaccgaaacaggcaaagcctatgccgcacctttaacagaaagcgcgcaggaattcagcgacaaagtatttgccacattcggcgacaagcgcacaactcggctgtttgccgatttggatgcactggctgaagtgatggaaaaaacaatctcggaaaataaaaaataggggggcaaatatgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttgaaaaatgccgtctgaacacgcttcagacggcatttccatccgttcggcaaactacatcacatccgcccgccggttgacaagtttggcaaacaacttttcaacagaagcttccgcctgcaaaccaatgcgctggatcaggctttgcttctcctgatatttcacttcgataacctgtttgttttcaaacgctttcaacaacaaatcatcactggtcgaaatctcgtcaatcaagttcaacgccaacgcctgccgaccgaaccaatgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaaaaagaatgcttcaaacgattgccgctgttttttataattttccgaaaaatccgtcagtacgacactgccgctttccgactgtttcttactctgtacgatagccaacacaatcagcgcaattgcgccgaacacggtaagcagttcgagcaggaaaataccgtaattcagtaaaatttctttccacattgattggatttcctcttgttcaggcatgaacatgtcaatattgtccatcaccgtccgacagataaaaaaataaccgcttggagcggcattgtcattttcagcttggtgcccggagccggaatcgaaccggcacgggatgtttagtcccgacggattttaagtccgttgtgtctacctatttcaccacccgggcatttgtgaaaggtggaggcgggggcgcggattttaaccggcctgtatgaagattgcactcctcatagcataaacactctgccaccccgccatagtacgataatggaggcgagagtcggaatcgaaccggcgtagacggatttgcaatccgctgcataaccactttgctatctcgccctaaaactggcttatctaaaaaacttggagcgggaaacgagtctcgaactcgcgacctcaaccttggcaaggttgcgctctaccaactgagctattcccgcgcgttcaaacatatcggtttttggagcgggaaacgagtctcgaactcgcgacctcaaccttggcaaggttgcgctctaccaactgagctattcccgcgttgatatgtttgaaataaaacttggagcgggaaacgagtctcgaactcgcgacctcaaccttggcaaggttgcgctctaccaactgagctattcccgcaatgattgcggaagaatgaaatttttggagcgggaaacgagtctcgaactcgcgacctcaaccttggcaaggttgcgctctaccaactgagctattcccgcccgatttcattctccgatatcgaagagacacaattattatggattctgtttttgccgtcaagctatttttatgtttttttcaggcgatttctttccacgccattttcagataatacagcatcgaccagactgtcagcaaagatgcgataaacatcaatacattgccgatgaatgcgaggttaaatccataaaaatcgggaaaattcagcagcagcaggaagattgccagcatttgcgcggcggttttaaacttaccgacggtggcgacggcaacgctgttccttttgcccatttgcgccatccattcgcgcaatgcggaaatggtaatttccctgccgatgatgatcatggcaaacaaaacataggtccggtcgagtttgaccagtaaaagcaaagagacggcgaccatcagcttgtcggcaacgggatcgaggaaggcgccgaaatccgaggtctgtttccacaaccttgccaaaaatccgtcaaaccagtcggtcaaggcggcaacggcaaaaatgacggcggcggtgagattaatcgtttcctccgcgaaccacggaaaaggcaggtaaaaaagggctgtcaggacaggaatgagcaagaccctcaaccatgtgaggaagatggggagattccaaggcatcggttttctctgtgcagactgtaaagttgtgattataacggttatcctcataacccaaaacgtaaaattgctgcatgggcattcccccgccccgccaatctgttttcacattcttttcaaacgcaggaaaatggcgggcaataaaagcaaaatacccagtttcaggctgaaaacggcaggttgtgccaacacttcgacaaggcggtcttccgtgcgggcaaaatctttattgcttatagacactgccactgttgcggtattccaacagaacgccgtttaaaaaacctttgccgacggtttcgcttaaaacggctctaacctgctccgccctgatggttctgccgatattgccgcctgtgcacaaactgtcgaacccatagcaggaaagccggtaatgctgcccgtctgcatccagtttgattgcccgtccgctgcggttgagggcggtaacggtcaattccgcatattcgaatgttttttcttgttcgtgaaatgccgtcaggtaaggtgcaataaaaacggcggacaacagcagacagcttatggcggcaaaccatacccagcgataatatagtggattaaatttaaaccagtacagcgttgcctcgccttagctcaaagagaacgattctctaaggtgctgaagcaccaagtgaatcggttccgtactatttgtactgtctgcggcttcgtcgccttgtcctgatttaaatttaatccactatatttcacgcttaccccttgtttctcaaatgccgtctgaaataagcggcttaatatattgtttacagtattgggaagcataacagacaaaatgccgtctgaaatattttcagacggcatttcttatccgaaacggattatttttgcgtttcaaccgcttccaatgcacgcagggcataagtgtaagcggcacccgcattcagggcaatggcggttgccaatgcacctgcgatttcgctgtcggtcgcaccggctttggtggcggcggcggcgtgaacactgatgcagctctcacaacgtgtagtaatggcaacggcgatggcaatcagttcgcgtgttttagcatcaagtgcctctgcagctgccgcttgttccaatgcgccgtaggcctgcagcattttaggatgcgccttacccagctcgccgaacgattttttaaccaatgcggtatgttctttccaatctttaaacattttcttttcctttctcttgcgtttaaccctgatacgcgcttgcgtatctgttttcgatgtgcgtattattgcaattattcagttgtgtttctcgtttaatcatctcattttatggttcaaaaagatttatggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaaggcgggcaaaaataaatcggggcttcaaacgcaaatgccgtctgaaaaggctttcatacagcatttgcgtaccgcgtcatttcaagggctgcatcttcatcacttccatcaaaaagttggtaaatgcggggttgttgggtttgacatccatatttttccaacgctgctgccagccgcgcaaggcattctggatatacagcttggactgttccgtattgattgcgccccgctggctgtctatcgccgaacgcaggtagatttcatacatactgtcatcgacggcattgcgtccgaccaggcgttttctgaagttgttcagatattgcgccgcctgaaccttggtcattttaccgatacccacctgatagcccaagcgcgtcgcttcatcgctgattttggcaacatccgtccaatgcgaagaggcaaggcggaaaccttttgcaggtgcttccgttttgacggtattgataggattcacggggatttccgtcaatgtgggcacataaatagactggcagccggaaagaactgccgcaatggaaagagggataaggtattttttcatgcccccattataatcaagtttgccttgagaaaacaaattgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataaaaaatgccgtccgaacatccttcagacggcatatcgggctttatttccccgccttcacatcctgccactggcgcaccataaacttcaatgccgccggctggataggcaccatgataaagctgtttttcaaatcctcctcggttgggaaaatcgtattgtcgtttttaaattcgtcttccatcagctcacgcgcaggcttgctcgaaggcgcgtaagtaacgaaattgccgtttttcgccgacacttccgggtcgaggaagtcgttgatgtatttgtgcgcgttggcgacgtttttcgcatctttcggaatcacgaaagaatccacccaaatccccacgccctctttgggcatcatcacgcggattttttccttgccgcccgcttcttcggcacggcgtttggcgatgttcaaatcgccgccgaaaccgattgttacgcaggtatcgccgcgcgccaaatcatcgataaagccggacgaagtaaagcgtttgatattggggcggtttttcttgagtagggcggttgcctccctgatgtcttccgtattgctgctgttcgggtttttacccaaatagttcaacaccataggatagatttccgccgcgctgtccaaatagctgatgccgcattgcttgagtttggacgtgtattcggggtcgaacaccaaatcccactggttgtccggcagcttgtccgtacccaaagcctttttcacgcgttcggtattgatggcgaaggtatttgtcccccaataaaacggcacggcgtattcgtggccgggatcgaccccgtccatcagcctcatcatttcggggttgaggtgtttataattgggaatcagcgacttatcgattttctgatacgcacctgccttaatctgcctgcccacaaacgcattggacggcgcgacaatgtcgtaaccggacttgcctgtcagcaccttgctttccagcgtttcatcgctgtcgtacacatcataagtaaccttgatgccgtttttcttttcaaaatcggcaacggtttccggatcgacatattccgaccagttgtaaattttcaatacgttttggttttccgccggtgccggtttttcggcaggcggtttgtccgaaccgccgcacgctgcaagcagcaaagcagtcaggacggccaggggcagatgtttggtcattatcattccttgcatatcgggttggagaaagcggccattatagccgatattggcaacagggcttcagacggcattcaaaatcccgccacactcttccgaaaaccgccgcttccatagctagaaacagggatttgcggtaagataccgccgttcgttttccctgcttttaccatgacaagacatttgagagacattgaaaaaattatgaaaacctccgaactgcgccaaaaattcctaaaattttttgaaaccaaaggccacaccgtcgtccgctcttccagcctcgtgccgcacgacgacccgaccctgctgtttaccaacgcgggcatgaaccagtttaaagacgtattcttaggtttcgacaaacgcccgtacagccgcgccaccaccgcgcaaaaatgcgtacgcgcaggcggcaaacacaacgacttggaaaacgtcggctacaccgcccgccaccacaccttctttgaaatgatgggcaacttctccttcggcgactacttcaaacgcgacgccatccacttcgcttgggaatttctgacttcccccgaatggctcaacatccctaaagacaaactgttggcgaccgtttacgcggaagacgacgaagcctacaacatctggttgaacgaaatcggtatgccgtccgagcgcatcgtccgcatcggcgacaacaaaggcgcgaaatacgcatccgacaacttctggcaaatgggcgacaccggcccttgcggcccctgctccgaaattttctacgaccacggcgaagaaatctggggcggcattcccggcagtcccgaagaagacggcgaccgctggatcgaaatttggaactgcgtatttatgcagttcaaccgcgacgaacaaggcaatatgaacccgcttcccaaaccttccgtcgataccggtatgggcttggaacgcatagccgccgtcatgcagcatgttcacagcaactacgaaatcgacttgttccaagacctgctcaaagccgttgcccgcgaaaccggcgcgccgttcagaatggaagaacccagcctgaaagtcatcgccgaccacatccgctcctgctcgttcctgattgcagacggcgtcttgccttccaacgaaggccgcggctacgtattgcgccgcattatccgccgcgccgtgcgccacggttacaaactgggtcaaagcaaaccgttcttccacaaactcgttgccgatttggtcaaagagatgggcggtgcctaccctgaattgaaagaaaaacaagcccaaatcgaagaagcattgaaaaacgaagaaagccgttttgcccaaacgctggaaaccggtatggctttgttggaaaacgcgctggtcaaaggcggcaaaacactcggcggcgaaatcatcttcaaactctacgatacctacggtttcccatacgacttgactgccgacatctgccgcgaacgcaatatcgaaccggacgaagcaggcttcgagcgcgaaatggaagcccaacgcgcacgcgcacgcgccgcccaaagcttcaaagccaacgcccaactgccttatgacggtcaagacaccgagtttaaaggttatagcgaacgccaaaccgaatccaaagtcctcgccctctacaaagacggcgagcaagtcaacgaattgaacgaaggcgacagcggcgcagtcgtcatcgactttaccccgttctatgcagaatccggcggccaagtcggcgatgtcggctatatcttctcaggcgaaaaccgctttgaagtacgcgatacccaaaaaatcaaagcggccgtattcggtcaattcggcgtacaaacttcaggccgtctgaaagtcggcgacagcgttaccgccaaagtggacgacgaaatccgcaatgccaatatgcgcaaccacagcgcaacccacttgatgcacaaagccctgcgcgatgtattgggcagacacgtcgaacaaaaaggctctttggttaccgccgaatccacccgtttcgacatttcccatccccaagcggtaactgccgaagaaattgccgaagtagaacgccgcgtcaacgaagccattttggcgaacgttgccgtcaatgcagccattatgagcatggaagacgcgcaaaaaaccggcgcgatgatgctcttcggcgaaaaatacggcgaagaagtgcgcgtactgcaaatgggcggtttctctaccgaattgtgcggcggcacacacgtttcacgcaccggcgacatcggcctcttcaaaatcatcagcgaaggcggtattgccgcaggcgtgcgccgtatcgaagccatcaccggcctgaacgcactcaaatgggcgcaagagcaagagcgtttggtgaaagacattattgccgaaaccaaagcccaaaccgaaaaagacgtactggcaaaaatccaagcaggcgcggcacacgccaaagcattggaaaaagaattggcacgcgccaaagccgaactcgccgtccacgcaggcgccaaactcttggacgatgcaaaagacttgggcgcagccaaactcgttgccgcccaaatcgaagccgacgcagccgccctgcgcgaaatcgttaccgatttaaccggtaaatccgacaacgccgtgattcttttagcggcagtaaacgacggcaaagtctccctgtgcgccggcgtatccaaaccgttgaccggcaaagtgaaagcaggcgatctggttaaatttgcagccgaacaagtcggcggcaaaggcggcggcagaccagatttggcgcaagccggcggcacggatgccgacaaattgcccgccgtgttggatagcgtgaaagactgggtcggcgcgaagctggtttgatgtgggaaaggcagcctgaaaggtttcaggctgccttttgtgcaaagaggccgtctgaaaggtctcgtttgccgtaggttgggtcgcgacccaacaaattttgtgaagtataaaaatgttggtcatgacccaacctacctgcctttttgtacaaagaggctatctgaaaggccttgtttgccgtatggtgggtcgcgacccagcagatttttattagggtatgacccaagctacttgctacgataaaaaaggatttttaaatgagcattagccttattggactacacattaccatagcaatcattttgttttttactacaaattttatgggaaaaaaatcatctatatttggctattaccaactgtcttttagcgaagaaaatcactctccggcatttaatattttttacagagcatttacccctatattatttatcgttattttttcttgggttgttactagtcttgaaattcccatttctcttgaaaagataaactatgtagtaatttattattttataattagattgttatctgtatttgtttttgagaaaacacacatagttaactggtttaatcaactaacaatacccatactatccataacattatcatttatagtatataacaaaatgattttgcccaaaagttttctacttccatcctcacaagaagtagctactactttttgaatagcgcttggtggttacatatataatatattaaataatgaatcagggcatttaaaatcttataaagaaagaagagtaaattatgtaaaacacatgcacaaaaaatttgaaagttattttggtaaaattatagataaaataatcaaagaggatagttataataatgatgattttttaaccgataagaaaaaagcactaatatattcagttttaatttatgagaattttaataggggactagtttatagatattttgaaaaaaattattttgtactggtagaataaaaacatttggaataatgcaagtaacctcagcagagtacctttccaatgaggaaagtataaaaaaaggcggaaatattcttatggaaaaatacaatgaaaaatataatgaatctattgatggcaataaaactctctataaatcatattatgaatcaagaagagagagtattaaaaactacaacccagatgcaaaatacattaatgaaattgaatcaatttacatgatgcttggagaaatctatccaaatgcaccagacttcatgtcaccacattttgagggggactgctctgagggggaataaaatcattatttattctttattagttattagcaggatttgtcgggcataaatgcccgacctacaaattcaattttttcaaacctctgccaaatattttcatctttgcaaggctgtctgaaaacccaaaccccattttcagacggccttttttcgctaaaatccccataccgttcaatccgaaaacacaggagaatcatcatggaagttaccatctccgccatcatcaatggcgaatttgccgaccaatacggcaagcgcggtagtcagtttaatgaaaacgggatgctgatttaattctatttcctttgaaactaccaataacctgcctccatcataaaactaaaagcaagccgtagcctgcattcccacaaaccgcgtgcgttgccatgtcacacaccctacctgcgggcgacgcaaaccttaagagacctttgcaaaattccccaaaatcccctaaattcccaccaagacatttaggggatttctcatgagcaccttctttcaacaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttgtcgaagacccgttatgtggtcgaacaaagcttcggtacgctgcaccgtaaattccgctatgcccgggcagcctatttcggactgattaaagtgagtgcgcaaagccatctgaaggcgatgtgtttgaacctgttgaaagccgccaacaggctaagtgcgcccgctgccgcctaaaaggcagcccggatgcctgattatcgggtgtccggggaggattaagggggtgtttgggtaaaattaggcggtatttggggcgaaaacagccgaaaacctgtgttgggatttcggttgtcgtgagggaaaggaattttgcaaaggtctccagcagtttgcgcatacatgccgtaacggcaaccttatacggcttaccctcggacagcgggcgttggtggaaatcccgaataagcggttcaaaacgtgtcgctgccacggtagccatatacagtgccttaagcaccgcagaccttccgccaaagcagcggcttttgaatttggcttccccgctcttcctcgggtgcggggcaatgccgaccaaactcgctatccgtttgtgcgacagccgccccaattcaggtagcatcgccatcagcgtagccgtcgttatcgaaccgatgcctttgatttgctccgccacttgggctttgccgtcaaaatgcgtgtgggtgtggtcgtcgatttgtttgtccgattcgtcaatcagccggtcaaaatgggcaatcagttgtttgacgcttccgacttgcgtttcgtgaacctgatgcagacggtttttctcggcagtccgcatatccgccgattggttgcggcggttaaccaaggcttccaacacttcttccgcttctgtgggcgggtggtagggcatggtttgccaatcttctttctgtgccttcatctgtgcgaagaaggcaggcattttggcatctttggcgtcggttttggtcagcgactgcgattgggcaaactgatgcgtctgacgcgggttggcgataatcacggctatgcctgctcggtggatggctttggcggcggggatttcgagacctccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgattcacttggtgcttcagcaccttagagaatcgttctcttcgagctaaggcgaggcaacgtcgtactggtttttgttaattcactatatctgtgcgttacgacggcatgccgtctgaagggtgtttatgtctgcatctaagaaatttccgattcctttgagctatttcagcatcgcgctgggcttgtttgccttggggctgtcgtggcgttacggcgcgtctgtcgggctgctgcccgccttggccgccgaatcgctgcttgcggcggcttcggtcgtctggctcttgctggtggcggcatacctgatcaaaatgtttgcgtaccgaaacgattttttgtctgatttacgcgacttggtgcaatgctgcttcatcagcgcgattccgattaccgctatgctggagggactcgcgctgaagccctatcaggcaggcgcggcggcagtcctgatttatgtcggcgttgccggacagttggctttttcgatgtatcgggcggccggtctgtggcgcggcctgcattccttggaggcgacgacgccgattatttatctgcctacggttgcgacaaactttgtcagcgcgtcatctctggcggcgttggggcatcatgattatgcagctttgtttttcggcgcgggtatgttttcctggctgagcttggaagcctccatcttgggcaggctgcgcacggcggcaccggtcggcacggcggcgcgcggcgtggtcggcatccagcttgcgcccgcctttgtcggctgcggcgcgtattttgccgtcggcggtaaagtcgacggttttgcgttggcattaatcggctacggctgcctgcagcttttgttcttgctgcgcctgacccgctggttttgggaaggtggttttacgatgagcttttggggattttcattcggtttcgcggcaatggcaggatgcggtctgcatctggcggcttccggcgtattgtcgggcttggggctgacgcttgccaccgccggatcggcaggcgtggcgctgctgcttgtcggtacgctgcaccggatagcgacggggcgtttcttggtacgcagctgatgcgttttgccgccttgtcaaaaatgccgtctgaaacgctgggattcagacggcattttttatttcacacccttacaggtagaatttttcgatgactttcaaattgtcgtccaatttgtacaccaacggctgaccggtcgggatttccaagcccataatgtcttcgtcggaaatgccctcgatgtgttttgccagcgcgcgcagggagttgccgtgcgccgccaccaagacgcgtttgccgctcaaaatcgcgggggcgatttggtcttcccaaaacggcaatacgcgctccagcgttactttcaggttttcgccgtcgggtacgacatcggcaggcagatgggcatagcggcggtctttgtgtgcggaaaactcatcgtctttgtccaaaagcggcggcagggtgtcgtagctgcgccgccagatgcggacttgctcgtcgccgtattgttcggcggtttgttttttgtccaggccttgcagttggccgtagtggcgttcgttcagccgccacgttttgatttgcggtacgaacagttggtcggattcttccaaaacgatgttgcaggtcttaatcgcgcgggtcaggacggatgtgaaggcgatgtcgaactcatagccgttttctttcagtttcttgccggcggcggcagcctcggcaagcccctgctcgctcagcttcacgtcgcgccagcctgtaaacaggtttttcgcgttccattcgctttgtccgtggcggataaataccagttccatatcgtctccaatgtgtgaaagtgggaaagccttatttataacatattttcacatttcccgtatttgattcagattcagacacgcgcccactatggtttgccgttttgatttacaataatgtcctttgctttacattccgcatacacaatgaatacgcaagcgcacgccccacataccgattccaatacgctgatgctcggccgatacgccgaacgcgcctatctcgaatacgccatgagcgtggtcaaaggccgcgcgctgcctgaagtttcagacggccagaagcccgtgcagcggcgcattttgtttgccatgcgcgatatgggtttgacggcgggggcgaagccggtgaaatcggcgcgcgtggtcggcgagattttgggtaaataccacccgcacggcgacagttccgcctatgaggcgatggtgcggatggcgcaggattttaccttgcgctatcccttaatcgacggcatcggcaacttcggctcgcgcgacggcgacggggcggcggcgatgcgttacaccgaagcgcggctgacgccgattgcggaattgctgttgtccgaaatcaatcaggggacggtggattttgtgccgaactacgacggcgcgtttgacgaaccgctgcacctgcccgcccgcctgcctatggtgttgctcaacggcgcgtcaggcattgcggtgggcatggcgaccgagattccgccgcacaatttgaacgaagtgacgcaggcggcgattgcgttgttgaaaaagccgacgctggaaaccgccgacctgatgcaatatattcctgcccccgattttgccggcggcggtcaaatcatcacgccggcggacgaattgcgccggatttatgaaaccggcaagggcagcgtgcgcgtgcgtgcgcgttatgaaatcgaaaaattggcgcgcggacagtggcgcgtcatcgtaaccgagctgccgccgaacgccaattccgccaaaatccttgccgaaatcgaagagcaaaccaacccgaaaccgaaagcgggtaagaaacagctcaaccaagaccagctcaataccaaaaagctgatgctggatttaatcgaccgcgtgcgcgacgagtccgacggcgaacatcccgtgcgactggtattcgagccgaaatccagccgcatcgataccgataccttcatcaacacgctgatggcgcaaacttcgctggaaggcaatgtgtcgatgaacttggtgatgatgggtttggacaaccgccccgcgcagaaaaacctgaaaacgattttgcaggaatggctggatttccgcaccgtaaccgtaacacgccgtctgaaattccgtttgaaccaagtggaaaaacggctgcacatcctcgaaggccgtctgaaagtctttctgcacatcgacgaagtgattaaagtcatccgcgaatcagacgacccgaaagccgatttgatggcggcgttcgggctgaccgaaatccaagccgaagacattttggaaatccgcctgcgccagttggcgcgtttggagggtttcaaactcgaaaaagaattgaacgagttgcgcgaggaacaaggccgtctgaacatccttttgagcgacgaaaacgaaaaacgcaagctgattgtcaaagagatgcaggcggatatgaaacaatacggcgacgcgcgacgcacgctggtggaagaggccggacgcgccgtgctgacgcagaccaccgccgacgaacccatcacgctgatcctgtcggaaaaaggctggatacgcagccgcgccggacacaatctcgatttgagccaaaccgcgttcaaagaaggcgactgcctcaaacaaaccctcgaaggcagaacggttttacccgtcgtcatcctcgattcatcgggcagaacctacacgctcgatgccgccgaaatccccggagggcgcggcgacggcgtaccggtttcctccttaatcgagctgcaaaacggcgcgaaacccgttgcgatgttgacaggattgccggaacaacattatttattatcaagcagcagcggctatggcttcatcaccaagctgggcgatatggtcgggcgcgtgaaagcgggcaaagtggtgatgaccgcagacagcggcgaaaccgttttgccgccggttgccgtctatgcctcctcgttcatcaaccccgactgcaaaatcattgccgccaccagtcaaaaccgcgccctcgccttccccatcggcgaattgaaaattatggcgaaaggcaaagggctgcaaatcatcggattaaacgccggcgaatcgatgacgcataccgccgtttcttccgagctggaaatcctgattgaaagcgaaggcaggcgcggcgcggcgcacaaagaccgcatccccatctccctgcttgaggcaaaacgcggcaaaaaaggcagactattgcccatatcgggcagcctgaaacagctttcttcccctaaataaacccggttccgcacatattatggtgatttccaacccccgcgaacttgaaaaactcaaagaccggattcccaatctgatcaacatcatccgcgtcgccatcgtttttccgctgatgattatgcacatcctcgggctggaaaccggcagccgtgcgaacctgcacgcttcgtggacggcgtgggcgttttatgtttggctcgccattgcctgctggctgattttcttttccattatccatccgcattggcaatggcagtcgctgaaaatgccgcgtttcagcgcggtagcggacatcacgatgatcggcgtgctgacctacctgttcggcggcatcgattccggcttcggcatcctgatcctgcccttcgtcgtctgctcctgcctgctcagctacgggcgctaccccctgctctattccagctacgccgccatcctgctgatattcaacgccattgccgacggcgatatcggcaaatacccgctcatatcggatgcccgaaccgcctcggcaaccttcatccttgtcgccgcctcctatctttccgccatcttcacctcactgtcggtcaaatacatcgaccgtgccggaaaactcgcctacgacagccatatcgcctaccaccgcatcaaaggcttgagccaaaccgtactcgaacgcgttcaggaagctgtcgtcgtcatcaatgccgaagggctggcggtgctgttcaaccggaaggcgaaagaccttttccccgcgctcgaaatcggacggcgcgccggtctgtccgattctgccgccgaactgtgggatcaagcctctccgcacactttcgaatacgtcctcggcacacccggcctgaacgccggcatccgcgccgttccggtcaacaaagggtcggacaagctgctcatcctctacatccgcccgcaaagcgaaattcaggcagaagccctgtccgtcaaacttgccgcgctcggacaactgaccgccaacctcgcccacgaaatccgcaacccgatgtccgccatccgccacgccaacgacctgctgcgcgaaaatatggaagcgggggcggcagatccgttcaacgccaaattgtgcaaaatcatcgacggcaacatctgccgcatcgacaaaatgctcgaagacatttcctcgctcaacaagcgcaacaaaaccgaacgcgaaaccatcggcctgataccgttttgggaagaattcaaacaagagttcctgctcggccatcccgatgccgccgactgcatccgtccggacattcaaggcggcagcccgaccgcctatttcgatcccgcccacctgcggcaaattatgtggaacctcgccaacaacgcgtggcggcacagccgcaaacagcccggctcgatttccgtcaccatccgccccgcgcaaaaaaacaccgtctgtatcctctttgccgaccgcccgaagtgcaggaacacctgttcgaacccttttacaccacggcggaaaacggcaccggcctcgggctgtatgtcgcccgcgaactggcgcacgccaatttcggcgatttgacctacctaccggaagccaaatgtttcgaactcacattaccggaaaaaaccaatgactgaactgcaacaccccgtcctcgtcgtcgatgacgaaaccgacattctcgacctgatggaaatgaccctgatgaaaatgggcttgcgcgtccataccgcgtcaggcgttgccgaagccaaaaacaagctcgacagccaacgctattcgctcgtcctgaccgatatgcgtatgccggacggctcggggctggaagtcgtccaacacatcaacagccgcctgctcgatacgccggttgccgtcatcaccgccttcggcaacgccgatcaggcacaggaagcgttgcgttgcggcgcgttcgaccccgataccatgcagatacaggactatctcgaccaaatcgaacgcgacatcatcgaacaaaccctcaaacaaaccgaaggcaaccgcacgcaggccgccaaacgcttgggcatcagcttccgttccatgcgctaccgtatggaacgcctcaacatcggctgacgacaaaacggcatccgcaccatctccgcccacccgaaaaaatgccgtctgaaacggcacgggaaagcgggttcgccccacgcccgaacggacacaaaacaccatgaccgacatccttattgacaacaccgccaccgaaaccgtccgcaccctgatacgggcattcccccttgtgcccgtttcccaaccgcccgaacaaggcagttacctccttgccgaacacgataccgtcagcctcaggcttgtcggggaaaaaagcagcgtcatcgtcgattttgcctccggcgcggcacaataccggcgcacaaaaggcgggggcgaactcatcgccaaagccgtcaaccacaccgcgcaccccaccgtttgggacgcaaccgcaggattggggcgcgacagcttcgtcctcgcctcgctcgggctggccgttaccgccttcgagcaacatcccgccgtcgcctgcctgctttcagacggcatccgccgcgccctcctcaatcccgaaacgcaaaacaccgccgcgcacatcaacctccatttcggcaacgccgccgaacaaatgcccgcacttgtccaaacacaaggcaaacccgacatcgtctatctcgaccccatgtatcccgaacgccgcaaaagtgccgccgttaaaaaagaaatgacctacttccaccggctcgtcggcgaagcgcaagatgaagcggcactcctgcataccgcacgccaaacagcaaaaaaacgcgtcgtcgtcaaacgcccccgcctcggcgaacaccttgccggacaagaccctgcctaccaatacacaggcaaaagcacccgcttcgacgtttacctgccctacgggacggacaagggataacgcccataaaacaagacaccgaaaaatttgccgttcttatgcaaacgagaaaccggtttttgcgtttcgactgttttggataagtcatcacaccttaaagtttgtcattcccacagaagtgggaatccgattcattcagttttatagtggtttaaatttaaaccactatagttgttttcgagtttcaggcaacttccaaaccgtcattcccacggaagtgggaatctagaaatgaaaggcaacaggaatttatcgtaaatgactgaaaccgaacggactagattcccgcctacgcgggaatgacggggcgggcagatgccgtctgaaattccgtcattcccgtgaaaacgggaatctagaacttctgatttttcagacgacttttgaacattgccgccacccaatgatctggattcccacctgcgcgggaatgacgaggtttcaggttgctgtttttaagttgctgtttcgggttgctgttttttatggaaatgacaaggttttagattgcgagaatttatccgctcctccgtcattcccacggaagtgggaatccagaaatgaaaagcaacaggaatttatcataaatgaccgaaaccgaacggactagatttccgactgcgcgggaatgacggggcgggaggatgccgtctgaaattccgtcattcccgtgaaaacgggaatctagaacttctgatttttcagacgacttttgaacattgccgctacccaatgatttggattcccgcctgcgcgggaatgacgatgtaaaattatccgggattcaaaaagacaggctttcacatccgtgggaatgactgcggaaagatgatttttatagtggattaacaaaaatcaggacaaggcgacgaagccgcagacagtacaaatagtacggcaaggcgaggcaacgccgtactggtttttgttaatccactatattttgtcataaaaatccgcaccttaatcagttggcggttaaatcaaacttttagggtgcagattactttttatgatttcagacagcattttgacaggcggcagcctatttcggcaataccaaaaacttaatcagcagttctttgaatacaaaaccgaacacgcccaagcccaaaaccaaaaacaaaatggcgatgccgaatttgcctgctttggactccttgcccaaattccaaacgataaaacccaaaaaaataatcaagccggtcaggcagattttcaacgcccaatcggcaaaaaccgcttcatccatatttttttcctattgttgatgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtagtacacggcttgaacctgcggctgcgcttgcagccattgtgcgattttcagggcgttgtcgaactgtttttccatacgcagcgacagggtttccacgccgctcaacaactgccacgcattaaacggcgacatcgccagcccgcaagagttgcaatacatggcgacctgcgccaacaactcttccgaacccgccaacacgccgcccatcacacgcccgtgtccgtctatggctttggtcgcggaggaaacggaaatatccgcaccgtgtttcaaaggctgcgagccgacgggcgacagcaggctgttgtccaccaccaagagcgcgccgatgccgtgcgccaattccgccaaggcttccaagtcggccacttcgcctaaggggttggacggcgtttccaaaaacagcagtttggtattggctttgacggcggctttccattcgtttatatcagtcggcgacacgtggctcacttcgatgccgaatttggcaacgatgttattgataaagccgacggtcgtgccgaacaggctgcggctggaaatcacatggtcgcccgcctgcaaaaaggtgaaaaacgccgcctgaatcgcagacatacccgccgaagtggcgaccgcgcgttccgcaccttccaaagcggcgatgcgtttttcaaaggcggctgtggtcgggttggcggtacgggtataagtgaaccctttgattttttttgaaaacaaatcggcagcgtgttgggcgttgtcccacatgaagctgctggtcagaaacaatgcctgattgtgttcgcggtattcggtttgttctttgccgccgcgtatggcgagcgtttgcggatggagttttttgctcatcggtgattcctcggttttgtccgttcggcaacggagcgtgcgcccgttgtttaatttgttaatattttgcgcctgttctatgatgctttcaagtcggatgagaatgcaaatgccgtctgaaacggctttcagacggcatggcaatcagcgtttgtattttaactcgtacttgatgtcgttgaggattttgcggacatcgtgttccaacacgtcttcgactaccgcccccgcctgctcgtgcagcatctgctggagctgataggtgaaaaccgccatctgcttttgcaccgccgttcggatgatgccgttgacggtatcggtcagatgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgccttcaacacacgggctcggctctcatcgtccagtttcggcacaggcgcgtccgttccggtttcagaggggcgggacagcggcgcgtaagtcggcactgccttcatacggcgcgtctgacgcaggttttccaaacgtttttcccaattcggctctttattcgcatccattttcggcttccggttcttaatctttgcaagcagacaaacccgcgcccaaagcgcggtttgatataatggcgcattttaacagattcgcgaggatacatcatgggcagcatcgaacagcgtttggaatatctggaagaggcgaacgacgtgctgcgtatgcagaaccacgtcctgtccaccgcattcaaagccttaatccgcgcccttcccgccgaaaccgccgaaatcgcggtcgagtcgattcagcttgcttttgaggacgccttggcagaattgagctatgaggacagcccgcatacggatttgttccacgacgttacttatgcgtttttccgtgaaaaagaacgttaattttatgttaaactgattttttaggctttttgattaccgaaaggaattttgatgaatatgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataagcccgcccgtccgaacacaatgccgtctgaagccctttcagacggcattgttcatcaatcggcctacaatgaactgcctgctgatttctccctaccgcaaagcaacaggcaaagattacaaatatcaaaatccgagtaaaacagtattttattaaaacaaattgataatcaagagattagaattatgtattgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttgaggcgccatgccgtctgaacacaaaatctgccttcagacggcatttccgcccccggttgcggtacaatccaccatttcatcactcggcgacccacaccgtgaaaatcctcattttaggcaacggacaggtaggttctaccgtcgcacaaaaccttgccgccatacccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataaaccgccccattccggacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgacgaagtttcagacggcatcgcccgcctgttttgatatagcggcacccccccgacaaaaaaacaatccggaacgcatctgaccgttccggcttgttttcaggcgaatccgccgcatcagaacatactgcgcacgcccatattgacctgccaagtctagcgcatcgtgtgcatcgaagacctttgcgcctcaaaataaagctgccttccgttgtcggcattaccacgcaaaaaaatgaattgcttgatattccaatgttttttatatgtttttatattgtgatgcgatcagacaaacgcccccctgacatttgtttagacggcatcgtattgctaaatttctataagtatgtataatgtccgtttccacgcgcccatcgtctagaggcctaggacactgccctttcacggcggcaaccggggttcgaatccccgtgggcgtgccaattcaaaaacctgcttgtttcaagcaggttttttattatgagtcgtcattcccgcaatttttcgtcattcccgcaaaagcgggaatctagagcgtagggttgaagaaaccgttttatccgataagtttccgtgccgacaggtctggattcccgcctgcgcgggaaggacggcagagggtggacgatgccgtctgaagcctgacaaagcatttgatgccgtctgaaacttcgtcattcccgcaaaagcgggaatctagagcgtagggttgaagaaaccgttttatccgataagtttccgtgccgacaggtctggattcccgctttcgtaggaatgacggaattttaggtttctgtttttgtggaaatgacgaataaagcgtgccggtttatgctcgccgcaacacgcggttcagacggcattgctctcttttttcattatcagtgggtgtagcaactgtatttttcaccccgtcgggcaaaaatacagttgctacgatgcaccccgccgccctgccctgtgccttgtcctgcaatacggcatataatgcaccacaaacccccgcgctgcggttttcagacggcatcgccgtgcttttttacaggcattagccctttttatcggacgcaatattaaggaggaacaaatgaaaagctcttttgtgcaaacgcttaccatcgccggttcggattcgggcggcggtgcgggcattcaggcggatttgaaaacatttcagatgcgcggcgtgttcggaacgtgcgtcatcaccgccgttaccgcgcaaaataccttgggcgtgtcggcggttcatctcgtcccgaccgaaaccatcaccgcacaaatccaagcaatcagggaagacttcgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgcttcccgatacggatgtattgacccccaacctgcccgaagcggaagctctgaccggcgtgcatattgaaaaccgtaaagatgcggaacgtgcggcaaaaatcctgcttgattacggtgtcaaaaatgtcgttatcaaaggcggacatttgaacggcagcacaagcggacgctgcacggattggctgtttacacaaaatgaaacgctggaattcgacagcccgcgctttccgaccgcccacacgcacggcacgggctgcacgttttccgcctgcatcaccgccgagttggcaaaaggctcggacgtttgcgaagccgtacagactgccaaggcctacatcacggcggcaatctcaaaccctttggaaatcggcgcaggacacggcccggtcaatcattgggcgtatcgggactaaccgtaaaaatgccgtctgaaacaaaatgttcagacggcatttttgaggattattcaggctttttcgccagcatcgttacaaatttaaaccgtatcggattgccgttttcgtctttggcatgcatagaacccaattcttctttatattcgaccagttcccaatcccgataataatccttcagctcgccctctttaaatttaaaagggaacggcatcggacaggggaaatccgccgtatccattgccgatacaatcaagttgtacccgcccgccgccgtatgcgcctgcatatcggcaatcacgtcgggtacgcgctgcggcatcaggaacatcagcaccactgttgccacaatataatcaaactcgccctgcaaggcggcggcgttcaaatcatattccagcgtgcggacgttcaaaccctccgcctctgccagctccgccacgtttgccaaggcggcgggattgtgatcgactgcagtaacttcaaaccccttcaaaccgagaaacagcgcgttgcgcccctgtccgcagcccatatccaacgccctgcccgccggtacggtatcccgtgccgccgcgaccgcagaatgcgtggcactcatcccgtattttttgtgaaaatagtctgccgccgcgcaatacagcgacaaacggatttcggcatcgtccgttttcggtttgacagaaaacacctgctgcggcgcaaacacacaatcgccgccgtctgccgaccaaacttctgccgacccgtccggtgcacgaacttcgacatcgccctgcaacacattcaggcagacccactccccttcctcagacgaatagcccgacaacaaaacttccggcaggttttccactttccatacaggcatctgtccgaaacaaaacaactcgccactttgacccactatccgctccttcatattcaaaaataaagttgcacattatatgcctattttaatccgccgcaatctttcagacggcacggcgcgcaaaccgcttataatcacgccggacaccacacaaaggcacaataatgaaccaaaccgtttacctttacaccgacggcgcgtgcaaaggcaatcccggcgcgggcggctggggcgtgttaatgcgctacggtagccacgaaaaagaacttttcggcggcgaagcgcaaaccaccaacaaccgcatggaactgactgccgtcatcgaaggactgaaatcgctcaaacgccgctgcaccgtcatcatctgcaccgactcgcaatacgtcaaaaatggcatggaaaactggatacacggttggaagcgcaacggctggaaaaccgcctccaaacagcccgtcaaaaacgacgacttgtggaaagaactcgacgctctagtcggacggcatcaagtcagttggacttgggtgaaaggacacgcgggacacgccgaaaacgaacgcgccgacgatttggcaaaccgtggcgcagcgcagttttcctgactgccgctccggcaaaaatgccgtctgaaaccgctaatgggcttcagacggcatcgtcctccaccgtcattcccgcgcaagcgggaatccaaaccgtcgggcaacggcaatattcaaagattatctgaaagtttgaagttctagattcccgttttcacgggaatgacgaaaagttgcaagaatgacggagtttcaggcggcatccgaccgccccgtcattcccgcgaaagcgggaatctaaaaacccaacgctgcaagatttatcagaaacaactgaaaccgaacggactggattcccgcctgcgcgggaatgacgggattttagtaaccgtagcaaccgcctgcgcgacggctaaggggcttcagcaaccgtagcaactgcctgtgtgggaatgacggacaatgggcttcagacggcatctcttgcctgccgctaaaacagtttgccgcacaactgttcaaacgcgtccgatatgtttcaacacacaggacgacacataaagcacctccctatgtgtcgtcctgatttggaaggggttacaccccctcccaaataaagtctgatcctgccgccctaaagggcggggtttcaaccgaaaaggaaatacgatgaagtggtacaattagcggcaatgcggacagacaaattaaactatagtggattaaatttaaaccagtacggcgttgcctcgccttagctcaaagagaacgattctctaaggtgctgaagcaccaagtgaatcggttctgtactatttgtactgtctgcggcttcgttgccttgtcctgatttttgttaatccgctatatcagaaattaccctaccgttttttaaacactttcaggaataaggaaaaatgaccgcccaaccctgccccatctgcacggcgcaaaatgaagacgttttgctgcaaacccccaacctccgcgtcatcgccgtccataacgacagcggttcgcctgcattctgccgcgtcatttggcgtaagcatattgccgaaatgaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgtctttccccgcgccgatttgggcaaaccccgtccggaaacacggtatgaccctgccgcaagattggacggaacagcttaaaaagctgctttaagcccgccgatgccgtctgaaaccgtatgaaagggaaattatgaccgaaccgacctcccgccgccgttttctgaaaacctgcaccgccgctgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgtcggttttaccgtaaccaaccaacaggcgggcagccgccgtttccaacggtttgccggcacggacacgcaacgtgccgccgatttccaagaggtcgcttccggccgcgtcgccacgcctaaagtgctgatgggtttgcgcggcggttacggtgcggcgcggattctgccgcatatcgattttgcttcgctcggcgcaaggatgcgcgaacacggcacgctctttttcggattcagcgacgtatgcgccgtccagctggcattgttggcaaaaggcaatatgatgagttttgccggcccgatggcttatagcgattttggcaaacccgcccccggtgcgtttacgatggatgcctttatcaagggtgcaacccaaaaccgcctgaccgttgatgttccttatatccaacgcgccgatgtcgaaaccgaaggcatattgtggggcggcaacttaagcgtcctcgcctcgctcgccggcacgccttatatgcccgacatcgacggcggcattttgttcctcgaagatgtcggcgaacagccctaccgcatcgaacgtatgctcaatacgctgtatctttcgggtattttgaagaaacagcgcgccatcgtgttcggcaatttccgtatggaaaaaattcgagatgtctatgatccgtcttatgatttttctgccgttgccaaccatgtttcgcgcacggcgaaaatccccgtgctgacgggcttcccgttcggacacattgccgacaaaatcactttccctctaggcgcgcacgcccgaatccgtatgaacggaaacagcggttattcggtcgcgtttgaaggctaccccacactcgatgcgtccgccctgactttggataccctgctcccaccgccggatttgcccatcttccccgaaagcggtgttgccgatatttcggaataaacccgcaaacggacaaatgccgtctgaagccttcagacggcatttcccaagacggcggcagattacagcaatgcccgaatatcggcttcgatttcttcgggcgtaacactaggcgcaaaacgctcgaccacttcgccgtcgcggttgacgaggaatttggtaaagttccatttgatgtcgccttcgtcgcgcttctctcccaaagctgcgagcttcaacacgaaatctttaaacagatgattgcctttatcttgcggtttgacggatttcaggtaggcatacaagggcgcggtatttgctccattgacttcgattttgtcgaaaatcttaaacttcgtgccaaacttcatcatacacacttgggcaatttctccgctgctttcgggagcctgttcgcggaactggttgcacggaaaatccaaaatctccaagccttctgcggtatattgtgcatacagcttctgcaaagcctcgtattgcggggtcagaccgcaacgcgttgccgtgttgacaatcagcagaaccttgccgcgatagcctgacaaatcaaccgcattgccttctgcatctttcatttgaaaatcgtaaatacccatttttatccttatctgatgtaaaccgatgccatctgaaacgtgcttcagacggcatgaaagcagcaattgtatagccgattaaaataaaaaatccacatccttttccattcccgtcccaatccgcaataaaaaactgcacccgaaaacgggtgcagttgctcatttcataccgcaaaacttatttgtcgcggccgaatacgattttagtggcttggatggcgacacagattgcaccgccgataaagaccaagtcagctgccgtacgtacccaacgcaaggtatcgaggatttccatttgcaggaactcttcgctgcgggcataccacagaccgtgcgtgatggaggcgtatgcctgaatcgcgccgacaggcagcaggctgatggcaatcataccggccaagccgccgttgagcagccagaagccccaagtcatcagtttgtcgtcaaactgcgcgttcggtttcaaataacgggcaaccagcaatacgaagcccaatgccaagaaaccgtacacaccaaacaaggcggcgtgcgcgtgaacggcagaagtgttcaaaccttggatatagaacagggaaatcggcggattgatcaggaagccgaatacgccggcaccgatcatattccaaaaggcgactgccacgaagcacatcagcggccaacgcaggcgtttcgcccagtcggacaggtgttggtaagaccagtgttcgtatgcttcacggcccagcaacaccagcggcacgacttccaaagcggagaagcaggcaccgattgccatagaggcggaggtagagccggagaagtacaggtggtgcagcgtgcccggaacgccgcccaacataaagatggcggcagcggccaaagtggaggcagtggcggtactgcggcggacaaagcccatattgtagaagacaaaggcaaaggcggcagtggcaaatacttcgaagaagccttctacccacaggtgaaccacccaccaacgccagtattccataacggcaatcggggatttttcgccatagaacaggcctggtgcgtagaatacgcccacaccgaccatagaagctacgaagatagccaacaggtttttgtccacgcctttttctttaaaggcggaaaccgtgcaacgcaacatcaggaacagccataacagcagaccgaccatcaaaaggagttgccagaaacgtcccaaatcgaggtattcgtaaccttggtgtccgaaccagaagttaaattccgggggaaggatgtgcgtcaacgcgaagaagttgcccgcgtaagaaccgccgaccacgatgaagagggcgatatagaggaagtttacgccggcacgttggaacttgggatctttaccgccgttgacaatcggcgcgaggaacaaacctgccgtcaaaaagccggttgcaatccagaagatggcggattggatgtgccaagtacgggtcagggcgtaggggaaccagtcggacatttcaaagcccaacgcctcgtcaatgccgtagaaaccctggccttcgacggtgtagtgcgcggtcagtccgcccagcaatacttgtaccacaaacagggcgaccgtcaggaagacgtatttgcccaatgctttttgcgaaggggtcagttggattttggaaatcgggtcttcagacggcacttccacttcctcgtgtttggtcaggaaggaataaccccacatcagcaaaccgatgcccatcagcagaagaacaacgctggtgaatgaccacatatagttttcagtggtcggtacgttgttgatcaaaggttcgtgcggccagttgttggtgtaagtaaaattctcgtcaggacggttggtcgaagcagaccaagaagtccagaagaagaagttgaacagtttttcacgcgcttcttggcttggcaatgtattgtttttcattgcaaagtgttcgcgagtggtttggaacttaggatcgtcgctgtacacaccgtggtagtaaggcaggatgctttcgatggctttcacgcgcgtatcgctgatgacgacgctgccgtcttccttcacgcggctttgattgcggtattcgtcggccaggcgtgttttcaagacggcttgttcctcgggggaaacctcgtcgaattttttgccgtaagtctgttgcgcggtcaaatccaaccaggcaaccaactcacgatgcagccagtccgccgtccagtccggagcctgatatgcaccgtgacccaaaatcgaaccgacttccataccgccggtagtctgccatgcagactgacctgccaaaatatcgtctttcgtcatcaagaccttgccggatgcggaaacgacctgttcggggtaaggcggggcttttttgtaaacctcgctgcccatatagccaagaatggtaaagcataccgccagaacggcaaacagcaagtaccaaagcttcttgtactgtcccattttgagagctccttttaatatagtggattaaaattcacaaaatatgaatgttaaagattgtagcacggtttaccgcgcaaataaacatttgttcaaagaaactcacatataaaacaaatacatatatgataataactatcattattctttagtcggcaactaccctgcctttgcctgatttgccgaagcccttaagcaaatcagcctatttattgtaatttttagtagctataaagtattagaagtatcattttaagttcatattttatgaattatttgacttaaatcaaaatgcccccaatggggcaaacgcataatcacaccaagttcttaaccaatccctctacttttcttacaaaaggaaaatattatgaaacgccaagccttagctgcaatgattgcttccttattcgcattagccgcctgcggcggcgaacctgccgcgcaagcccctgccgaaacccctgccgctgccgccgaagccgcaagctccgccgcacaaaccgccgccgaaacaccgtccggcgaactgcccgttatcgatgcggttaccacccacgctcccgaagtgcctcctgcaatcgaccgcgactaccccgccaaagtccgcgtaaaaatggaaaccgtcgaaaaaaccatgaccatggaagacggtgtggaataccgctactggacatttgacggcgacgttccgggccgtatgatccgcgtacgcgaaggcgatacggttgaagtggaattttccaacaatccttcttctaccgttccgcacaacgtcgacttccacgcggctaccggccagggcggcggcgcggccgcaacctttaccgctccgggccgtacttccacattcagcttcaaagccctgcaaccgggtctgtacatctaccactgcgccgtcgcaccggtcggtatgcacatcgccaacggtatgtacggtctgattttggtcgagcctaaagaaggcctgccgaaagtggataaagagttctacatcgtccaaggcgacttctacaccaaaggcaaaaaaggcgcgcaaggtctgcaaccgttcgatatggacaaagccgttgccgaacagcctgaatacgtcgtattcaacggtcacgtaggtgctatcgccggcgataacgcgctgaaagccaaagcaggcgaaactgtacgtatgtacgttggtaacggcggtccgaacttggtatcttccttccacgtcatcggcgaaatcttcgacaaagtttatgttgaaggcggcaaactgattaacgaaaacgtacaaagcaccatcgttcctgccggcggctctgccatcgtcgaattcaaagtcgacatcccgggcagctacactttggttgaccactctatcttccgcgcattcaacaaaggcgcactgggtcaattgaaagtagaaggtgcagaaaaccctgaaatcatgactcaaaaattgagtgataccgcttacgccggtaacggtgcagctcctgctgcttccgctcccgcagcttctgccccggcagcctctgcatccgaaaaaagcgtttattaaattggatacccgtcattagcgggacgaaccactgccgctgtacttcattacgcacggcggtggttttttaacaaccaatctttcctttcggaagattgattttaaccgcctgtcaggaggctttatgaagtatgtccggttatttttcctcggcgcggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggtttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgtaccagcctgcaatccaaatatgtcttgcacaacttgggcttccgttgcacaagccgataaccccttcaattatagtggattaacaaaaaccagtacggcgttgcctcgccttgccgtactggtttttgttaatccactatattccgccatctctaagatttacagcgatacacgggtaatttaaggaatgcccgaaccgtcattcccgccactttccgtcattcccgccactttccgtcattcccgccactttccgtcattcccgcaacttttcgtcattcccacgaacctacatcccgtcattcccacgaaagcgggaatccagtccgttcagtttcggtcatttccgataaattcctgctgcttttcatttctagattcccactttcgtgggaatgacggcggaagggttttggttttttccgataaattcttgaggcattgaaattctagattcccgcctgcgcgggaatgacgattcataagtttcccgaaattccaacataaccgaaacctgacaataaccgcagcaactgaaacgtcattcccaccacttttcgtcattcccaccacttttcgtcattcccacaaggacagaaaaccaaaatcagaaacctaaaatcccgtcattcccgcgcagatgatatgttgcccgtcaacacaaaataaaaaacaaagttgcaatatactgatttatattgttatttttatttacgtttatttacgatatgcaaatgcacggttacacaaatatattcgcgtaaccgtttaattttgttgaattttattgattcaatcggtgtctttccgcatcgtaaggctggccggttttaacaatgtaataggcgagcttcgccagtttgcgcatgatggcaacgatgattaccatctttggcttacccgcttttttcagattatttattaatttcggaaatgcgttaaaacggtaagcacaaagggcgggcatatacagcgtactttttaatcgtctgtttccgtatcggctcaatctgccccgacctcttacgcttgtccctgattgtatgatggcgggatttaatccggcataggatacaaactggtttgcggttttaaaatgtttttctgtcagttgcgcataaagaactgatgcggtgtctttgcctatgctcgggatggtttgaagattgcggtaatggttattgtccgtttgttttttgatttgttcggatatggctatttttacctgttccatcttgtcctgtatggtatctatcaagtcttgatgtatgttccttatgaagtcttcttcagtgctatgaagacggtttttaatttgcttctgatgttgatgtaattgatttttaaggttaatcagtttttgcagtgctttgtttttgggtatctgatacggtatcaatgtatcttgatgcctttttatgtagtctgctatcaggtttgaatctgctttgtcggttttggtacggttaaacctgctttttccgtagtccttgatttttaagggattaataacgtaaacagtatagtaggaagaaagcatatctgctgccttttcgtaatagatgcctgttgcctccatgccgatatagacttttctgattctgtttccctttatccacaatctaaactgttttaatccatcatcattattcttaaatttaatgtaatggatacttccgtttgttttatgcaatgttgcgtctatggtgtcctttgagatgtccagcccgattatattcattggtattttccttatttatacagccttgatacggctaggatgatattcaatttcgaggatggataaaggcagccggcatttctacgcgtctgttttaatacattgcgggatttgctgcctgactgccttagcccttgctttgcgcgaaacaaagacccgtaaaccgtctatattcaaacggtttacgggtcttttttctctcttgccgttttcttcagtttgccgatccgaccacgcccccgccgattccttcaaacggtttcccgcgttcttcccaattatcgtacattaggttctgctacggttttccgcccaatgtggcaacttgcgccctgtccgaatgttgctgcgcgctttgctgaacttcctgcccttggctttcttctttgtatgggttaaacggcaagccgttttttacatagtccttgcacatcaactccgtcacttctttcaatgccgtcccttgatgcgaatagcaggcgcatccggttcttccgccttctatacagcctgctatatattcaaaggttcttacctgccttacaccgttataaatcggcttgctttcgggtttttcggacaatgtcggaacaaacatatctgcggtaaggttgccgttatttaccggctcgccttctgttttatccggaagtactgcctgctgttctgttgccgccgattcttgtgctgcgggttcttcctgtttttttccgtaactgctcaacattttataggacaggccgacaaacacgggaatcagcaatactattactggcagagtgtaaaaccactttgaccgcttgaccttatttacggtatgaacttccgctgattcgtacaagtcataaacttttttatccagtgtatagatactggagaatgcgcttgatgccatttttacgggatcgtccgcgcatattttccattctaaaagcgtacgcatacccatcttgtttgaagcgatgtggtaatgtttccgtacaagcgttctaagattttgatctagaagcttaggaccttgagtcaaaacaaatatatcaatgccctgatgtctgtgcgtattcagccattggacattttcagggatttttgaacctgccgagcgtgccggccatacgtcttgagcttcatctacaatgacaatagacccgatattttcgggcttctttatccattcgtacatatcatgcgccgaaagctgctcatctgtcgatttcggcagcttttttgcgtccgtttctatgtaggtgtgcggtattttcaagccttttatgttcgtaaatactttacggcgtatgccgttttcatcaggcttaaacatttcatcattcgccatcatggaaaccatttttaatgttttccctgaaccgggcgtgccggttatcaaacagatctctgccatttattttttcttcccgattgaggttgctagttttgtcatttgtttgaatgacagaataaaggcgatcgcgccaaacaggatattaagaacggttccaccgccgcttatataaaaaagctgcaacatcgcttgaggcgcgcccgttatgctattggttatcgcctgctgaaaatgggctaccaatctatccacccctgaataggttaccgccatcaagcctaatgcagtcaatatacggcctgccacgctcatcaaaagcggaatcaatgcggccaacaatttcatttgctatccctttcttaaaaggcacggttgcctcattaaacaaatgtttcttaatctgaaagattttgcgccgcattcgcggcgcggcggcgctgtggggacacccccctcgcgcttatcgccaatccccccgcgcttctcggctatttgcgacattcgtcgcaaagtgcgctgcttcgcctgcctttcggccaaagtttccgaagctgaacgctttgcgggggactagtcccccacaccccctagtctcacttgcgacgccgcgggggcatggggacggcgcaaaaggcgcgcgccttaccacctgcccttgcggcagaatgtgttcttttggcggggcggcaaggggtatccaaaaagatttataaagacgataaagccgtctttacaaatctttctggacgtcctccccctgccttggtacaagttactgaagcccggcggtgctgcgcctgctagacttcacgagatactgtgcggatacaaaaaaaggcggcaaccgcccaagcaagggcgagaagcatgtaccttagccgttcggctatggtacatgcgttctcaaagctgaacgcgaactgcctgcttgaatcaagcacagtcactgtgaaagtgacaggtgcgggacactgtgcggaatcttgaaagattcctgatttctgaaactctacattgacggtttcagacggcagatttaaatcttctgccggattggactcgggcagcctgtcgcaagcgagaatgtcggggaagaatttgcacaaaaggccgccatctttgccgtcctttccgtctttgccgtccctgccgtttgtgcgtcccggaacggcgggggaatcgggtcttgtgccgggctgtccgtccgtatcgggatttgcatcgggattcaaatcggggtcgggttcgggattggggctcgtgccggggttctcattggggttcgggttgtttgcggggttttcggcgggcgatacttcgggcagcggctgtgcgttcggtgcttccgcgcttccgggggtcaagtcgggacgcgggattacttgaacatccaccgtggtgttgccttgcgaatccctgccgaatgttgcgacaacctgaacgggattcccgttcctgtccgtgacgggacccatattcacttttgttccgggtgcgacttctactttttcggaataaccgggataaccggttgcctttatgtatttgtcgggattggcatcgactttcaacgataaaatctcttccagctttttggcatccatttcttctttgtattttgaattgcgaataagggaaaaatcagccccatttctgaaatcatcacctttattgaccaaacaatctccgccattccaattaaatgtgcaacgatttaaaacaaaattattccaatccaaagaacttaatttattcagttcttctttatgccaattccaaaacggacgtgccagcctatacatttggctttccatcaattctttgacttcggggaatctgctgtcatcggacataaggcgcataatcgaactgtcaacgccgtagcagccataggttctattaatacgtcttttgtcttcgtaccaaaggcaattactatattcgtagccttttacaaatttgtcggtttcggggtcgtattggtagccttgtgcctgtatgtcttctttgaaagtttcgtatacgtcatgggctaaaagggctgttccgacataaggaactgcccttgtgcttaatttcgcgcctaagcgggcaagtttgccgactcctgacaagacggcggcgcgggaaactgatgcggtaaatttaacggggactttttcaagagagcgtgcacctgttggcacgtgttctattattgaaggttcgataattcgacctgaaaaacgctgaccatcaacacgaaaatcggtaactacagattttttatgatcaatatccaatctaacatctgaatttccaataggatacttaaaacgttcagcataagaattaaccgaaaacatccccaacattaggattaaaatcaaacgttttaatttcaattccacgactataatcatcctgtaattctaaaatttttatatacgcaacagactcatcagaaaaataaattttccaaatattattagaaatccttctatttaaaaaacattggatttcttcatgaattataaatttattaacttttgaataatccaaaagctcactagcgaaagtatatgccattgttttaccataatacttgcttgacggctgatatttataaagtgccaactgcgcctgcgtgataaacggtttgttcattgttctgcctttcaaaggttgttttgaaagcctgattttaaaacacgtcatttaaatatcaaagcgacagacaaagccaagaagaaaccgagaagaaaccaaaaatcaataaccatcaatcaatcccaaccttgcccatgtcttttaaaaaattaatcaaaagcctgaagccgtaaatgactacgaacagaattaaaaccgtcgaaccgacataagaaccctgtttgatctgctcaaaattggaacatttcggataggacaacattaccggctttccgttcaagacccatttttcgcccaccctttccggcctgatgatttttccgtcctgggtaacagtaggaggaagggacgacaataaatagtcgtctgcatgcaatcttgtatcaaaacaatttatgccgacacgatagcccatttatacgcccctttttcttcactctgtttatttgacagatttaatcatgctccaagccattttgaagccttggattgcaagaatcacggtaatggccgccatacccacggcggaaaccattgacacgaaacccatgattacattcgctacttgcgtaccaatcgcggatggatcaaaggtatctgccataacaatggccggtgtgaagataccggctgccaaggctgcttttacagcgtattttttaacgatgttcatcgtttttttccttttttgatatttaaaataagacgacttcttgacttgcttcatccggacgaagtcttttccgaatctcgtttttagccgataaaatagaggattgcgaaaagaaaaagaaacatacagaccacccagccgataattagtgttgcaaggttcattttcatgatatttttcctttgttgcgggctttgtgaaaggttgacagaccgcccgccgagcctgtttttcttttattccgattttacgaagaactgaaatatctggaatcctccgcctatttcatttatgcctgaattcaacgcatcttcgtagctttcaaattgacctgctgatttaatattttgagtaaaccccacatcaccgaaaggatcgggataaataaagtcatgcgtttccaagtcttgaactatgaaacgttcttcaaatttcataaatcaacctttcggcttttctgccacctgaaaatcaattaatgaaggaaccatgcccttacctgtcgaagtcatttcaaccgttaccataacttcgcacgggtatttgagattctctaattttgagaaattcttactgtccccgaacttcatttgtgctgccgtgaatccaacagcatttcccgactgtgccggcaaaggtgttgcaaccaatacggaacaagtgtcgatattagagccatcaatttcgcctttgaattttttagctcctaaaaaagttgcgggataagttacagtttgagtttgattaaacatattaatttttcctttttaggttaattttgatttgcatgaagatcatacattctgtcgagataaagctgatattgcctctcactttccacatcgtgatgtggatcgaaaagccttttatccggatcgaatttatctgattgcttaaatttgataattccgagttcttccaattcaacctctaaatctacatccggttgttcgtggataaagccgaatttcaaagattccttcaatccggccaacgaatatttttcaggttctagccctttgggataccccaaatctgccttcagatatctgacaatttcatcactatcaaaacccatatcaaacatgaaattaatcagtttgccgaccgcgttttttgcgtatctcaatttatgctgaaaagttaaattagccacttttttacggtaatcgaacctttccggattcggcatatttttaaatttctgacaaatcgggaaagcgcctgaaaagtaagaaccttgatttatcagaatatccaaaggtatttccatatctccatgattaaactgaatttcgaaccttacccacttgctttctttatcgcctagctgcctgcctttctcataaacacgcacaaaacgagaatttttcttgcgacctacataaaatgtcttgccgctcccgtcctctctccgccaagccgttccaaccatttcagatttcggcctcatgttactgttatcgaaaaaaccgttatcgtgatccaaaagtgcctgttccggcgtgtactccccatcaaaaaaatcaagtgccaaatctacccgcgttatcctcggcctcaatgaatcttccaaaaactgcttaagcctcaattcccaacctggatttgcaatgttgcaacctacacctttcaattcgattaaaaccgtatttcgctgacctccgtaatggacttcgccgtagtcaacttcttccgatcccaacctaaacatcgaatcgtaaaatttattgcccttcgatttgcatctgctcgtgatgccaaaccctaatatttcctccaattttttgcttaaaacaaacatatattcggcatcggaaactaaggggcatccggaaactttcagcaaggaatcttcgtgcagtgtgaatgacaaccaatctataaaaacgccgtcctgcctgcccctacgttgcggaatttctaataacttcccattgccgttagatatgaaatgggaaaaatattctgcttcactcattttgttcagtacctttagggatttgttttatttcgctccccccctgttagtcaggggggggctttcagccgtttcccgtctgccgcgctaaagcgcgtccaacggtcaacgaccgaaagcccaatcctgacaaactgttaaagatcaagaagaaagaccacaaccgtctgttgtgataattaccggaaaattcgagccaaccgaatctatataatcgaacgcctgataaagctttgaaaaattttcttgttcagcgagtttatgcggttcaccatgcctgaactgatagaaacataaaacgcaataatctgattttttaaatattctccaataggaacaagaaaatattacatttgctactgacataaaaaagcccctttcacttggctgtcaaaggggaatgttaagaaaagtaatgcgcccctttgatagagcgcatcatataaggcgggaatccagtccgttcagtttcggtcgtttccgataaattcctgctgcttttcatttctagattcccactttcgtgggaatgacggcggaagggttttggttttttccgataaattcttgaggcattgaaattccagattcccgcctgcgcgggaatgatgaattcatccgcacggaaacctgcaccacgtcattcccacgaacctacatcccgtcattcccacgaaagtgggaatctagaatctcaaactttcagataatctttgaatattgctgttgttctaaagtctagattcccgcctgcgcgggaatgacgaatccatccgcacggaaacctgcaccacgtcattcctacgaacctacatcccgtcattcccacgaaagcgggaatccagtccgttcggtttcggtcgtttccgataaattcctgctgcttttcatttctagattcccactttcgtgggaatgacggcggaagggttttggttttttccgataaattcttgagacattgaaattctagattcccgcctgagcgggaatgacgattcataagtttcccgaaattccaacataaccgaaacctgacagtaaccgtagcaactgaaccgtcattcccacgaaagtgggaatctagaatctcagactttcagataatctttgaatattgctgttgttctaaggtctagattcccgcctgcgcgggaatgacggctgcagatgcccgacggtctttatagcggattaacaaaaatcaggacaagacgacgaagccgcaggcagtacaaatagtacggaaccgattcacttggtgcttcagcaccttagagaatcgttctctttgagctaaggcgaggcaacgccgtactggtttttgttaatccgctataacagcaaccttgtcgccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattctagattcccgcctgagcgggaatccagtccgttcagttccggtcatttccgataaattcctgctgcttttcatttctagattcccactttcgtgggaatgacggcggaagggttttggttttttccgataaattcttgaggcattgaaattccagattcccgcctgcgcgggaatgacggctgcagatgcccgacggtccttatagtggattaacaaaaatcaggacaaggcggcgaagccgcagacagtacagatagtacggaaccgattcacttggtgcttcagcaccttagagaatcgttctcttttttgttcatccgctatattgtgttgaaacatcgccacaaacctgatatagtccgctcctgcaacatcattgaaaatctttctttttaatcagttaaaaccgaatacggagtcgaaaatgaatccagcccccaaaaaaccttctcttctcttctcttctcttctcttctcttctcttctcttctcttctcttctcttccgcagcgcaggcggcaagtgaagacggcagccgcagcccgtattatgtgcaggcggatttagcttatgccgccgaacgtattacccacgattatccgaaagcaaccggtacagacaaagacaaaataagcacagtaagcgattatttcagaaacatccgtgcgcattccatccacccccgagtgtcagtcggctacgatttcggcggctggaggatagcggcagattatgccagttacagaaaatggagcaacaataaatattccgtcaacacaaaagtgttgaaagaaaaccagggcaacaggataaaactgaagacggaaaatcagggaaacggtacgttccacgcctcttcttctctcggcttatccgccatttacgatttcaaactcaacgataaattcgataaattcaaaccctatatcggtgcgcgcgtcgcctacggacacgttaaacatcaggttcattcggtggaaaccaaaaccacgatttataccactgcaccaacgggagacgctacagtgggaggcactatcccagagagaccgagtagcaaacctgcctatcacgaaagcaacagcatcagcagcttggggcttggtgtcatcgctggtgtcggtttcgacatcacgcccaagctgaccttggacaccggataccgctaccacaactggggacgcttggaaaacacccgcttcaaaacccacgaagtctcattgggcatgcgctaccacttctgattccccgataccgatgccgtctgaaccttcagacggcatgagacctttgcctgcgtacttggtacgctggtcgcctccgaacatggcgcgacacccgacatttccgccgaacgcatcgggcgtttcatgaatccggtttaaaacgcatggaaaaatgccgtctgaaagcctttcagacggcattgtgcttgagattccgtttaccaatggctgacaaacgcttccaaatcggtattcttgggcttatgcacttcctctgtcggcgtgccgaccatcatcagcccgatgattttatccttatccgcacaaccgaaagcctcccgcaacagggggctattgacccacatccccgtaatccagacattgtcgaatccctgagccgttgccgccagttgcagcgcatacgccgcacaacccgccgtcagcatctgctcccattccggtttcggcttaggcacatcgcggttcggcgcaaacgttaccccgataaccatcggcgccatattgcccactttttccgcctttttcatcgcatcgtcgccgaaattcaattcggcaaccgtttgcttcaacacatcgcgaaaacgttgcaatcctacctcgccttgaatcacggtaaaacggaaggggcgcatattgccgtgatcgggaacttgggttgccgcctgaaatatttgttccaactccgccgcatcgggggcggggtgcttcagctttttggaagatcggcggttcgtcaataattttaaagcatccatatcgttatactccggtcatcggtcgggtgttcggacacatatgccgtccgaaggcttcagacggcatatccggcatcagcgcggacggcggcaggctgccaatatatccatttccttccgataggtttggctattggaaatgtccatcagccccaataccgtgctgaaatagtggtcgtgcgaatattcgttttccgccgctttttgtttgaggcattggaaatctatgcccccgtgttggcggaaggctttggaaaaccacataaccatcgggatatgcgtctgcccggaaggcgcgatggcgtaaggcgcggcgtgcaggtacatcccgttttcgcccaaactttcgccgtggtcggaaacataatgcaccacgctttccaaatcgtcgcggttttcaagtttgcggataaccttgtcgataaactggtccacatacaaaaccgtattgtcgtaagtgttgaccagcgtggcgcgggtgcatttgttgatttcgttggtgtcgcaggtcggcgtgaatttgcgttcggcttcggtatagcgttcgtaatacgtcggcccgtggctgccgatggtatgcaggattaaaaccgcgtctttatcgtttttgttgaggacttcgtcgaacttagtcagcaggatattgtcgaggcactcgccgttgcggcagtattcgggcaggttgagcgaggtaacgtcggtattcggcactttgccgcacacgcccttgcagccggaatcgttttccaaccaagtaacttccacgccggcgcgctgcacgatgtccagcaggttgtcttggtgttcggctttgatttcgtcataatccgtgcggtcgaaggttgagaacatacacggcagggagtgcgcggtcgatgtgccgcagcttctgacctgcgggaaattgacaatttcatcgccgcgcgcggcaagcagcggcgtagtttggcggctgtaaccgttcaaaccccagttggcggcacgcgtggtctcgcccacgaccagcaccacgaaacggcgcaggctgccggccgggcggttttgcacgaccgccatatccaattgcgtataaggaatattggaacgcttccaatctttgtatttcgacacgcccgcgccgatgaaattagacggcacaatcagatgggttactgatttattgttgcggaaaaacgaggcgtaatcctgatattgcaacattgcgatgcccaacgcgcacaaaaaggaaacggcggcaagcacaaggcgcgtcaaaagctccttataccaaacgcggtatttaaccttgacggcgatatacgccagcgcgggcaatacgcccaaacatacaatccacagcacatagcccggcgtaatcaggcgcgcgctttcggcagccgtagtttgcaagacattattcaacatcgacttgttgaaatagatattgaaaaatatttcttggtaagacaccgccgcactgataaccaatatcaacggaatcaataccttatgcacgaaaggcagggcaatgacgtgaaaaacgaaattacttaaaaaaaacagcaccaccggcatcgtatagaggaagatatccgccccggtgccgttaaaaggatgaagctcgacaactttggcaaaaaaggcgtaattcaataccagcgaggaatacagggaaaggaaggcaatcagcgcggaagagccgagcttcggcctcaggttcggttttatcatttggaatgtgtcggataagggttggaaaaggcatccggcatttggaatccggattattgaaaaagattcttaattataaggcaacggagcaaagcagggcaagaaaacggcggctgtgcggggggttccgcccgccattcaaacgtccggcagacataaaaacatcgtaagcaagattcgaaccggtctgcaaccgcccctgccagaaaaacgggcaaagcatttcatattggaaaaacccagccgcgccgccgacgggacagtccggcacaaacagcatcacgctcggattgaaaaggacggatagccgccggcagcacaatcttaccacctccaaaacgccgccggagaacgccgaaacagccgatgccgtctgaagccgcttcagacaacatcgggacatcaaccgtaacgccgttggaaatcgcgcataaaatctgccaaagcccgcacgccttcaagcggcatcgcattataaatgctggcacgcataccgccgacggttttatagcccttaagcaggcacaagccctgcaattcggcttccagcacaaaacggcggtcaagctcctcatcccccgtttggaacacgacattcattttagaacgcgcattcggacggatacggttgatataaaaaccatcgctgccgtctatcgtctcatacaaggtttgcgccttcagccgattgaccgcttcaatttttttcacaccgccctgcgcctgtagccagcggaacaccagccccgacatataaatcgcgtaagttgacggcgtgttgtacataccgtcgcggttgatgtgcgaacggtagttgaacacatcgggaatatcgttcggacaacgctcgagcaaatcctcacgcacaatcaccaccgtaactcctgccggcccgatgtttttctgtgcgcctgcgtaaatcagtccgtagtcggcaacatcaaactcgcgcgacaaaatctcgctggacatatcgcacaccagcggcggcatgccttctgaaaggcacggcacttcacggtattgcagcccgttgaccgtttcattgacggcaaaatggacaaacgccgaatcgggtgcaacatcccacgtttccacaggcggcaggtcgagatagtcgaactgctcgccgccatgcgccgccaaacggatttccgtatcggtcaaacggctcatctgttcataagcgatacggctccagttgcccgttaccaccgcgtcggcagtgcggaaaccgtgtgccagattcatggctgccatattaaattgggttgttgctccgccctgcagaaacaatatcttatagttgtcaggcactttcaaaagctgcctcaaatcctgttccgcatgatgcaggatgctcaaaaacatttccgaacggtggctcattgccatcacaggaaaacccgtaccgttgtagtccaacatttcctgccgcgccgtttccaacacggcttcgggcaatacggcagggccggcggaaaaattgtaaatcggataaagagacatgatgcagccttgattctgaacaataacccgcccgattttaggcttgcagcaggctttgtgcaaggatggaaaatacctgtcctccgcccgattccatgccgcccgaacacggaaaataatatcaatatattgatttacaaacataaaaatcatgcacgcgacaaatagatacatttgttttgtcaacaatattcacgatttcccattacaaacctcccttacacccgcttttttccgtcccaaaaacacaaaataaatcaacactttcatttctccgcaaaagcggttataatcacgccgatttttcaactttgacgaaaaatggccacggggccatttttttattatgtacatagggagcagcatggatatccaaaccatcctcgaaaaaaccctgcccggcctgggctacgaactggtcgatttcgaactgaccgcgcaaggaacattgcgcgtgttcatcgacaaagaaagcggcattaccgtcgaagactgcgcaaccgtcagcaaccacttgagccgcgtcttcatggttgaagacatcgactacaaaaacctggaaatttccagccccggactcgaccgccccttgaaaaaagccgccgacttcgtgcgctttgccggtcagaatgccaaaatcaaaacccgcctgccgatagacggtcagaaaaactttatcggtaaaatcgaaggctgcgaaaacgataccgttaccgtatccttcgacggcaaaaccgtacaaatcgaattgggcaacatcgacaaagcccgtctgcgccccgaattcaaattctaaaacacaacaatattggagatgttcaaaatgagtcgtgaaatgttacagctggcagaagcactggcaagcgaaaaaaacgttgatgcggaagtcgtcttccaagcactggaattcgccctgtctaccgccgccaagaaaaaggcagaccgcgaacacatggacgtgcgcgtccaaatcaaccgcgacaccggcgaataccaaaccttccgccgctggctgattgtcgccgatgaagactatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtccggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcattctgagccgtacttccggcgatttcctcgtcaaactgtacgccaatgaagtacctgaaattgcagacggcatgcttgaaatccgcgctgtcgcccgcgacccgggacaacgtgccaaagtcgccgtcaaagccaacgaccagcgcatcgatccgcaaggcacctgtatcggcgttcgcggttcgcgtgtcaatgccgtcagcaacgaattgtccggcgagcgcatcgatgtcgtcctctggtcgcccgaacccgcgcaattcgtgatgagcgcgctctcacccgccgaagtcagccgcatcgtcatcgacgaagacaaacacgccgtcgatgtcatcgttgccgaagaccagctcgcgctcgccatcgggcgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataaagggggtacagatgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacagcagcaccatcagcatccgccgcaccaaaaccgaagtcagcaccgttgacggcgtaaaagtcgaaacacgcaaacgcggacgcactgtcaagattccttctgccgaagaattggcagcacaggtaaaagccgcccaaacccaagccgcacctgtccggccggagcagacggcagaagacgcggcaaaagcccgagccgaagctgccgcacgcgcagaagcccgtgccaaggcagaagcggaagcggcaaaactgaaagcggcaaaagcaggcaacaaagccaaacctgccgcgcagaaacccaccgaagcaaaagccgaaaccgcacccgttgcggcggaaaccaaacccgccgaagaaagcaaagcggaaaaagcccaagccgacaaaatgccgtctgaaaaacccgccgagcccaaagaaaaagccgccaagccgaaacacgagcgaaacggcaaaggcaaagatgccaaaaaaccggcgaaacctgccgcacctgccgtgccgcaacccgtggtcagcgcggaagaacaggcgcaacgcgacgaagaagcacgccgtgccgccgcacttcgcgcccaccaggaagccctgttgaaagagaaacaggaacgccaggcacgccgcgaagccatgaaacaacaggcagaacaacaggcaaaagccgcacaggaagccaaaaccggcagacagcgtcccgccaaacctgccgaaaaaccgcaggcagccgcgccagccgtcgaaaataaacctgtcaatccggcaaaagcgaaaaaagaagaccgccgcaaccgcgatgacgaaggtcaaggccgaaacgccaaaggcaaaggcggaaaaggcggacgcgaccgcaacaatgcacgcaatggcgacgacgagcgcgtacgcggcggcaaaaaaggcaaaaaactcaaactcgagccgaaccaacacgccttccaagcaccgaccgaacccgtcgttcatgaagttttggttcccgaaaccattaccgttgccgatttggcgcacaaaatggcggtcaaaggcgtggaagtggtcaaagccctgatgaagatgggcatgatggttaccatcaaccaatccatcgaccaagacaccgccctgattgtggtggaagaactcggccacatcggcaaacctgccgcagccgacgaccctgaagcattcttggacgagggcgcggaagcagtggaagccgaagcattgccgcgtccgcccgtcgttaccgtgatgggccacgtcgaccacggcaaaacctcgctgctggactacatccgccgtaccaaagtggtacagggcgaagcgggcggcattacgcagcacatcggcgcgtaccacgttgaaacccctcgcggcgtgattaccttcttggacaccccgggccacgaagcctttaccgctatgcgcgcacgcggtgcgaaagcaaccgacatcgtgattctcgtggtcgccgccgacgacggcgtgatgccgcaaaccatcgaagcgattgcccacgccaaagctgcgggtgtaccgatggtggttgccgtcaacaaaatcgataaagaagccgccaacccagagcgtatccgccaagagctgaccgcacacgaagttgtgcctgacgaatggggcggcgatgtacagtttatcgacgtttccgctaaaaaaggcctgaacatcgatgcattgctcgaagccgtcttgctcgaagctgaagttttggaactgaccgcacctgtcgatgcgcccgccaaaggcatcatcgtcgaggcgcgcttggacaaaggccgcggcgcggttgccacattgctggttcaaagcggcacgctgaaaaaaggcgatatgctgctggccggtacggcattcggcaaaatccgcgcgatggtcgatgaaaacggcaaatccattaccgaagccggtccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgtgcagggctcttacgaggctttggcgggcagcctgaaaaaactgtccacagacgaagtgaaagtgaacgtgttgcacagcggcgtgggcggcattaccgaatcggatgtcaaccttgccatcgcttcgggcgcattcattatcggctttaacgtgcgtgcagatgcctcttcgcgcaaacttgccgaaaatgaaaacgtggaaatccgctactacaacatcatctacgatgccatcaacgacgtgaaggcggcgatgagcggtatgctttccccggaagagaaagaacaggttaccggtacggtcgaaatccgtcaggtcatctccgtttccaaagtcggcaacattgcaggctgtatggttaccgacggcgtggtcaaacgcgattcccatgtccgcctcatccgcaacaacgtggttatccacacgggcgaactggcttcgttgaaacgctataaagacgatgtaaaagaagtccgcatgggcttcgagtgcggtctgatgctcaaaggctacaacgaaatcatggaaggcgaccaactggaatgcttcgacatcgtcgaagttgcccgcagcctgtaattcctttgcaaataaaatgccgtctgaagcgttcagacggcatacgaaacgggttctgtatcatacagaacccgttttttgtcgcaaatcggcttcagacagccctcttgccttatcccgatttgaatctgacttgccatacaaacaggcttcagacggcattatttgcccgctaaacgtatcccaagcttctccgcatattccctgcgttcggcgcggctggtttccgggcggtgcgtattgagcgacgaccatttccaatgactgcgggctttgttgagttcgggcgggagtctggcggcatcccacgggactttgcggctgtgcagctcgatatccgactgtgccgcgtgtccgcgcgtttgcaggacgtggagcaaatcgagggcgcgggcggcgagcagggtcagggtttcagggtcggtgtgcagggtttggcggccagcgagtttgtcggaaatggtgcgggtattgggcaggatgccgcccaaaaagccgccgattgccgtacccaatccgagcgagccgccgagtgtggcgatgtccagccccaagccgatgagcgcgccggttgccgcgcccgtgccggtgcggatgccgtattgtttgagcaattcgctgtcgaacgggtcttggcggaaggcttgcggcatccagtcgccgccgtcgatttcgctgtggtagaaacggtagagggcaaacagccgctgctgcatctgccgttcgagttggcgtatttccgcctgcatggtttgcagcacggtggcggtatcctcgttttcgtccacttcctgcctgaaggcggcggcatcaattaaaaagtcggcgatttcgcggcgcgcttcgccgtccagccgctgccattcgcgccggcgcatggctgtcaggcggtcaagtgtgctgcgttcgggcaacatggtggcgaggttttcccacaggcgcagttcgccttcaaaatcaaaggcgacggtgtcgaaccctgcgaaaacgtgcaggtttctcctcgccagcatggttgtccacgattcgggaagctgtccgccggtaaagttgaacacgggcataaccggtttggcacaccatgaaaggatggtcaactcgtccctgtatttgtcgaggacgggttcgcgcgcgtcgatgacgtacattgccatatcgctttgcaagacttgccgtaagactttggcttcctgattgaaatcatggtgcgcaccgtggctgccgagaaactgttgcagccgttcgatgccgtctgaacgattgtccgtatggttttccagccattccagcacgccgcccgcgtcttcgagtccgggcgtgtcgtacaggaaaaccagcgtgtctgcgccgtcgctgatggcggcttcttcgacatgacgcgtggtcgatggggcgtttttgacttcgccgaaaccgctgtcgcgcaaaagggtacgcaggagcgaggttttgccggtgttggtgtgtccgacgacggcgagggaaaggggttgtttgttcatgatgtttttgaagaatggattttcagacggtcttttttcagaatggcggcttaacagaacatttcaagtgagtttattggtctttcaaacgcccttcctgcgccgccctgtcaggctcaagccacgccgcgccgcattcggccagcgcgttacgccaatgttccagcttttccgaaaggtcgtctgaaagcccctgttccgccaaaagctgcaccaccgcgccgccctgcgccgcttccgagagtcggacaatctgccgcaacacgccgcggtccggcacagtttgggcgcgcacgccgataagcagttgcgccggtttctgcttcagctctgtctccagcgcggcaacctgttcccgattggtggcaacgcccttatccagccattcctgcgccagcctgccctcgaaccattcgccgtcctgccactcggtctccagcatgaccgcccatttcggcgcatcgttcaagatgattttcggtgaaacggcggacacggtttcccgacgcgtatccgcatcggtgattttgttctgccagcggcggatgaccgcctgataatagggcttttccaaatccaatccgttttcgcttgttttcaaaaggattttacacactacccaagccagcaggcgcggcaggatgccgtagcaggcgatactgccgaccagcagccccgaccaagcccgcgcatcggcaatattgccgttcagacggccttcgatgaccgcccgcgcatcggggacagggaaaccgagtttcgacggcagccatgccaacatttccaccgcgcgtaccgaagcggcattgctcaacagcgtgctttcccagttgaacgtatattgccgcaccaaaagcagcaacaataccgacaccagcattccgagcagcgtgcagagccacaggctgtgcgacgttgcgcctattttccaacgtaccgaaggttgccgccactcgtccgcatacagccgcaacaccgcctgatttacagggtctttgccccgaaaccacgtcgccggactgctgaaaaaacgccccactttcacacgcaggaacaacattgccaaccatactgccagcatcagcgtattcatgcccaacacgcccgccaaaaccaaaaagaaattcagaccctgattgtccattagaagataagtgactgaaaaaccggtaaaaaatgcaaacgtcgccgccaccacccacaaccagaacgaccccgcacgcacacgttccaacgtctcccgcagcatacggttcctgtcaatcatctccgcccgacggatgattttttcctccgtactgccgtccacgcggcgcaaagcctccgtcgcctgtacgggatcgccgctgaaaataaaaccgccttcgtccaaaatacggaccagctcaaccagttttcgggatggattcaacataaaatgccgtctgaaaataaaaaacagattttaacacacgcattttcaagaatattcacagtgtaggcaaagagtaaatctcacacagaagcaaaagtatcggcgtaaactgactgcctctactttcccgaaagattgtgcgatgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctgaatgccgtctgaaaagcaaaacctcccgttcctgaagattgggaggttttctgtttgccggacatcagcccttgtcgtggaactcgtggaattcatactgataggacaaatcccgacccgcttttttctgtgccaaataatcatcataaatggcgcggatttccttacgcaacaaaaacagggctatcaggttggggataaccataaaaccgttgaacatatccgacagactccaaaccaaatcgactttgccgagcgtacccaaaacaatggcaagcagaaccaatgcgcgatagatgcccaagtgtcttcccctgaaaagaaaacggatattggactcgccgaaataataccaaccgatgatggtggtgaaggcaaagaaggtcagacacacggcaagcaattgcgaaccgaagcccggaaatgccttgttaaaggcaaattgagtaaccgccgcgccctgttcgcccgaaaggttggcatcggtcagcaggataatcaatgccgtagccgtacataccaaaatcgtatcgataaacacaccgacaaatgccgccataccttgctgcacagggtgcttcacatccgcagtcgcgtgggcgtgcggagtcgaacccatacctgcttcgttggaaaacagaccgcgcgccacgccgaaacgtatcgcttcgcgcataccgatacccgcagcaccgcccaaaacggcttcgggattgaaggcggcggtaaagatgtggttgaacatcggcacaatatggtcggaaaattcaaacaggataacgacggcgcacaaaatataaacaaccgccataaacggcacgacaaattgggcgatattggcaatacggttcacgccgccaatcacaaccatgcccgcaaggacggcaagcacaataccgactgccaaagaaggcacatcaaatgcaatggtaacggcagaagcaatggagtttgcctgtgtcgcattaccgataaagcccaatgcgataatcaacgcaatggaaaagaaaccggacaaaaaacgcgccgcgcccctgccgattttcggagtcagaccgtgggtgatgtagaacgccggcccgccgatgtatttgccgtggctgacgacgcggtatttctgcgccagcagtgcctccgcaaaaatcgtggacatccccaaaacggcagaaacccacatccaaaaaatcgcgcccggcccgcctgcggtgatggcggtcgccacgccggcaacgttgcccgtaccgatttgcgcagatatggcaaccgccaacgcctgaaactgcgataaagacttgtcgtctttatcgcctttggcaaacaagccgccgaatacggatttgaatcccgcgcccagcttggtaatctgcggcgcaccaagatacagcgtaaaaaacaggccgatacccaaaagcgcgtaaatcagcaggtagtcccaaaggaaccgattgactgtacccaccagaacagacaatatattttccataaaataaaccttatcttacaattaaaatgactgccttccaaaagacattccaataaggaaacacggcgagcagaccgtatttgccgcaacagatgccttaaattgtcaacaatcggggagaagctgcgccatcataccgtaaaatatcgttaattaaaacatttctttatttttaagcggaaagcggaggaaatcgctttcagacagcatagacaacggcacggcataaaacaggatattttgggtacttgcaacttatgttaaaatgccgaccgtaaaaaatctgacaaaaacagattaattatttgaaataagaaaggaaatttatggcaggccatagcaagtgggcaaatatccagcataaaaaagcccgtcaggatgccaaacgcggcaaaatctttacccgtttaatcaaagaaatcaccgttgcggcgcgtatgggcggcggcgaccccggttcaaatccgcgcctgcgcctggctttggaaaaagcagccgaaaacaatatgcccaaagacaatgtgcaacgcgccatcgacaaaggcacgggcaacttggaaggcgtggaatacatcgagttgcgctacgaaggctacggcatcggcggcgcggctttgatggtggactgcctgaccgacaacaaaacccgcaccgttgcggacgtacgccacgcgtttaccaaaaacggcggcaacttgggtaccgacggctgcgtggcgttcaacttcgtgcatcagggctatttggtattcgaacccggcgttgacgaagacgcgctgatggaagcggctttggaagccggtgcggaagacgtggttaccaacgacgacggttccatcgaagtcattaccgcgccaaacgattgggcgggcgtaaaatccgctttggaggcggcaggttacaaatccgttgacggcgacgttacgatgcgcgcccaaaacgaaaccgaactctccggcgacgatgccgtcaaaatgcaaaaactgattgacgcgctggaagacttggacgacgtgcaagacgtttacacttccgccgtattgaatctggactgatacgcagcacagcagacatacaataaaatgccgtctgaacctttcagacggcattgatttatttagcccttgcccacgcccaccaaaccgtcaggacaaccgccagaaaatacgccacgctccaaacaggcaaagcaattcccagcagataatccggttcagcacaatttccgaacccgcgcacgacaggctcgaaccaatcaaacaaaggccagcctttcaagcggaacgtccacggcgcgccgcacgaaggagcggttcccggcggcagcgactgcaaccacaactgatatgccgcaacagaaatacccgtaacggccggaatgctgataaagacagcaccgaacaaaccgcctgcccttcttcttggtctgcacatcaggacaattgccgtacacaatgcggttgccaaaacgcataaccgctgactgatacacaaaacgcaaggctccatacccaaaacatactgtgccgccaaagaaccggcaaatgcacagaccgaaacggcaaacagcagccaaacggcttttctaaataacggggtcattttctcaacacaccaatcaaaataccgatatgccgattttgctggatatatcccgagatggcaagggacaaaacggcgatttgcccgcacaatgcccacaaaaaaatacatccggaggatttgaatttcagcaaatttagcgaatcaaaagtttatttcaatgaaatcatatgatttttttgaataagcggattgatgggtttttgaaggaatttgttaccggatagccatcgggcaagttttttgcaaaatttgaatcggtcgggtaaattttcaaaaaataattgacagcggataagaaacggcggataattcccgccgtcgagttgcttgatgcagcttgatttttctcctctatttctcctttgtagacttggcacacattcaactggatgtgtgcatttttttatctccgctttttttgaaatttaattacttttattgtttgaaattccattctttaagaaatttaacaagaaaaacgcttgctttttgaccggaaaagctgcataattcattccgttagctggttcgagtagtcagttaatagtttctcctctatttctcctttgtagacttggcacacattcaactggatgtgtgcatttttttatctgaagcaacaagcctctgtgcgtgatgttgttatgtttcatttaggtgtcaaaccgcatatccggtctgaaatattcaatccaaatccaaaaccggattttctttgacctcctccatcacaacataactcctactctccgaagcggcaggcagttgcaataggatattgcctagcatatcccgataggcagacatatcgggcaaacgtactttaatcagatagtcgtattcgcccgacaccaagtggcattccataatttgcggaattttcagcacttcttttttgaaatcttcgaaaatattgcccgatttggattgcagcttcagctcgacaaaaaccaataaaggtttgcccaacagatggggattgagatgggcgtgataaccggaaatataatgttcccgctccaaacggcgcaccctctctgtaacgggcgtggtggacaagcctaccttctcggcaagctccgtcatcgggatgcgggcattctgttgaaggatcttaaggatgcggaaatcgattttatctagttctttcatttagattgccttgtatttattattgattttaacaaatagagtatatagtggattaacaaaaaccagtacggcgttgcctcgccttgccgtactatttgtactgtctgcggcttcgtcgccttgtcctgatttttgttaatccactatatatttgagaaagcgattatatcaggaaaagcaaaccgccttcctacctgaaaactgctgcttcggcttgaagacacaaggttctttaatattttaaaagccttgccgttggattataatcccccaaccgatttcttaattttgctaataaacacttgcttggtaaggaatgaatttatgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaatcaagtccaaacgaaaatgccgtctgaagcctttcagacggcatttccccatcaaaaccgcaatcagtttttcatcgattgaaccggagccggaattctgccgcctcggttgacgaatacttcgcacgaaccttctttgaccggcatcacaggcgcgtagcccaacaagccgccgaactcgacgctgtcgccgacggttttaccggttaccggaataatgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaagaatcagcatgggtggccgccgcgatttgggcaatcggcgtaacggaaatgcgctgattcacaatcggtacgccgtatttggcagacagatattttgccgtagtgaccaagtctttgccgactgtggtaattttattgtaaatattttggttcaacacattgatatcgctgctgatgcagtcgtgcaaatcaatgccgatggtaatggtgcggacatcaaaattctggtcggcaaccattttgacggtttctaaaatttcgccggattggatactcatcacattcctccaactcaaatgcggtgcatcgcttggaagatttcttcgttttgcatacggatatcaagcgcgagttttttgctctcttccgcaaacaaatccaaaacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgcttccatacgccgtttgccttattttgcttaaactggatttcgctttccttgccgccgttacggtaatagcggtatcccgtaccctcactcaagccatttttataaggcataacggcagattttttaccgttcggataccagttgacccactccccgtccggcttacccttgctgaagccccccgccatttttttctgaccattaaaatgccacaaaatcaacataccgttttgcagggtaggcacaaaagatttgatttgcgttgaagcaacgatataaggttcagaatatttcttcatcgacggataataaaaatcctgcgcgtgcgcaatacccgccaccacactatattgcctgatataagcggcagaagacatcgtcgccgtcagctttccgttctgattaaaataaacagaataggtctgcgccggcaaagcggccgaaaaacccaacaggacagttgaaaatacaatccgagataattttttcattgcaatagcgatataaaaacaaggctgtgttttagtaatctgttgatttcaattatttgcaagggaaaagacaattattttccggttaggaataaacctattctattgaatatattgaagccaagtacgcctatcaacactatattaaaacactgccaaaaacaattaacttataaacaatatggtaaggatttctctgccaagcatcaaacccgagacaacgtatcgtaaaaatgccgtctgaaaacaaatcgtcttcagacggcatttccccttcaactcactcttcacccaataactgctcgcgcgtcaagaggaaaacaaaaccgtcgcccccgctggtttccaaccaagtaaaaggcaactccggatacgctgcttccaatacatccctgttatgcccgatttccaccagcaatacacctttgggattcagaaactttgccgcattcagaagaatctgcctggtggcatccaacccgtccgccccgctgcccaatgccaattccggttcgtgcaaatactcttcaggcaataactcaaccgattccgcatccacataaggaggattggaaacaatcaaatcataagtgccttccaatccttcaaacaaatccgtatgaataagccggatgcgttcttccaaaccataatcttcgacattaatccctgccacttccaaagcatccaagctcacatcaaccgcatcaatttgggcatcaggataatgatgcgccatctgaatggcaaggcaaccgcttccggtgcaaagatccaaagcattatgcaccaactcatcgtattctatccaaggacgaagtccgtcacccaacaattcataaataaaagaacgaggtatgattacgcgctcatccacatagaaatcaaactctccctgccatgcctggtgtgtcaaataagcggctggaatgtgttcgacagcacgacgctcaataaccgccagcacttcctctttttcagcttccaagagttttgcatcaagatatggggcaagcatatccaaaggcaaattcaaagtatgcagaatcaaataagctgcttcatcatgcgcattatctgttccatgaccaaaaaagagccctgcctcattaaaacggctgactgcaaaacgtaaaatatcgcggatagtcgtcaattcttgtgctgcctgattaaacataatatgaaccattctgcgtatagatacttttaattataacagaaacaacaagcaaaccttttcatatcgccaaataaccacccaatctacccatacaactacataaatgcccgcgcgaaaaccatcgcccgaacggaaacgacaatggccgacggtatgggcaatctgattggctgggaaaaaacggggcttgttgtcggtaagcagtggataaccgcaaaagacgacaaggtgtccgatgtctgcaatgccaacggcgagatgggcgtaatcgggctttacgagcctttctcacacggcgcattgacgatacccggtcatccgaactgccgatgcgaggttgtttccgtatcgggtggcgaattgggggaatttgccgaaaaaaaggagcttcgtaaagcggctatgcagtatgcgcgggataactttatcggcaaaagctatgtcaataaaaacagcgggcatgaactgaaggtaacttggcaaggtgtgaaacacgctgcgtcaaaggcaaatcaggcggaattatccatcatgacaaaacttgatgacttattgcgctacgcaaaatatgagggttcttattcggataggaaaggtcatcctaatattattgcagcacataagtatcgtgccgttgccaaggttgggaatgagtctttaaatatcggtgtgattgtaagggaatttccagacgaccataaacattacgaccatttcatcttgaaggatgaataaagcccttttgcagtgtcgttctggagcggatagcgttaaggcaagtacacttccagccttgaaaaagggctttaaattcagcatgccatttatacaggcaggagtaaacccatgacaaagttatacgcagaaatcgccaagatggagacgcaggacgacgacacggtcaaggtttggggttacgcttcaagcgaggaaatcgattcggacggcgaagtcatcgcggcggcagctatgaaggcggcgattcccgattatatgaagtttggcgcggggcgcgagatgcacggctcaaacgctgcgggaacggcaattgaaatcaacgtggaagatgacggcagaacctttttcgtggcgcatatcgtcgatcccgttgccgtgacgaaggtcaaaacaggcgtttacaagggcttttccatcggcggcagcgttaccgcccacgatgagttgaacaagtcgcaaatcacgggtttgaagctgacggaaatcagcttggttgaccgacccgccaatcccgatgcggtgtctacctgctttaaggcggacaaaggtgcggaagcggtaaacaacgatacagaacataatgctacatattttagccatttcccttccaaacaaaaaagcaccgacggcggccgatgccctttcctttacaggttcccctattttttatccgcgggcagcaccggtttggctggggcttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaaacgagctgattattatatcagcattttgttcttggtcaagtgtgacgtcgccctgaatggattctgttccattcttccgttttgatttgtacagtattggtggaggcaaacgggatcgaaccgatgaccccctgcttgcaaagcaggtgctctaccaactgagctatgcccccgttcttggtgggtctgggaggacttgaacctccgaccccacgcttatcaagcgtgtgctctaaccagctgagctacaaacccggattctcttcttaagcgaatcttgccttcactcaagcttcttccgcatctttttcagtttaccgataagtgtgaatgcctaaagcctcttctttctctagaaaggaggtgatccagccgcaggttcccctacggctaccttgttacgacttcaccccagtcatgaagcataccgtggtaagcggactccttgtggttatcctacctacttctggtatcccccactcccatggtgtgacgggcggtgtgtacaagacccgggaacgtattcaccgcagtatgctgacctgcgattactagcgattccgacttcatgcactcgagttgcagagtgcaatccggactacgatcggttttgtgagattggctccgcctcgcggcttggctaccctctgtaccgaccattgtatgacgtgtgaagccctggtcataagggccatgaggacttgacgtcatccccaccttcctccggcttgtcaccggcagtctcattagagtgcccaactgaatgatggcaactaatgacaagggttgcgctcgttgcgggacttaacccaacatctcacgacacgagctgacgacagccatgcagcacctgtgttacggctcccgaaggcactcctccgtctccggaggattccgtacatgtcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttttgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcattttgtatccaaacggtatctaatgtatccgtactttgttatagaatggctgctgttttttcttcgtaattagaaattgtcaaaatgggcaaacatattcttttaggtgtaacgggcagtattgcggcgtataagtcttgcgagttggtgcgactgctgaaaaaacaggggcattcggttacggtggttatgagccgctcggcaactgaatttgtttctccgctgacttttcaggctttaagcggcaatcctgtcctgaccgacacgcacggcggcaacggttcaaacggtatggaacatatcaacctgacccggaatgcggatgtttttctgattgcgccggcaagtatgaataccgtggcaaaaatctgtaacggcgtggcagataacctactgaccagtctggcagccgcacggaaatgtccgcttgccatcgcgcccgcgatgaatgtggaaatgtggctcaaccctgccaaccaacggaatatcgcacaactggtttcagacggcattactgtctatatgccgggcttgggcgaacaggcttgcggagaaaatggtatgggaaggatgccggaacctgccgaattgctggatctgcttccggatttatggacaccgaaaattttaaagggcaaaaaagtcttgattaccgcaggtgcgacatttgaagccattgaccctgtccgaggcatcacaaatatctccagcgggaaaatgggcgtggctttggcgcgggcgtgccgtgccgccggtgcagaagtcagcctgattcacggacagcttcaaaccgcgctgcctttcggcatatccgatacggttcaagccgtcagtgccgaaaatatgcatcgcgcagtgcatcgtttaatcgacaaacaagatgcttttatttctgttgccgccgtctcagactatagggttaagaataggagtactcaaaaattcaaaaaagataaaaatgccaaaccgttatccatcgaattggatgagaaccccgatattttggcttctattgcctcattaccgaacccgccgttctgcatcggttttgccgctgaaacggagaatgtaatgacatatgcgcgggaaaaacgtattaagaaaaagctaccgatgatcgttgccaatgatgtttcaatcgcaatgggcaaaccgaccaaccggattaccattatcggggacgacggggaactgtcttttcccgaaacaagtaaagatgaagcggcaatgcggattgttgaaaggcttgccgtatatttgagcaaataagcaattgaacggataaaccataaaacgggttgcctgttaatcaaaaggcaacccgttttacctgcttcaacttctgatgactttgcggatatatggaatactatgcagattttgaataatctgattcaattgattcagattcttgactttcaataagaatttgaattcgacaaaaccttccgttcccgactgggatttagacggtgtttcgaccgactcaatgtctgcaccggaatcggaaatcgcttgcgccattaatgccaacaggccgtggctgtcttccgattggacttgaagcccgacacggtagttctgcccgttcatattttcccagtctgcatccagctgctgttcgggatcggacttcaacaacgtcgggcaggtatccctatggataatcatgccttttcccttaaccaacagcaaacggatggaatcgccgggaacagggtggcagcactctgcaaaatgaatatgcccgctttcctgcccatcgactttaatggaactgagcctgacctcgctgccgaaatgctcccctgccaactcggcaatgtgcatggcgacataaacaggcagggtatgccccatccctacgttgtacagcacttcttcaaacgatgtctgcttgtcgttgagatcggcaagatatttttccttgatgccgtctgaaagcaggacatctttgggcagcaaactggacagggctttttgtaagaggctctctcccaaaacgaccgcatcgtgccggttaaggtttttaatatattggcgtatggcgctgcgcgccctgcctgacacggcgaaattcaaccacgcgggattgggtttggcgtgttcggatgtgataatttcaacagaatcaccggttttgagcttcgtacgcaacggcatcatgatattgttgatacgtgcggcaacggttttgtgcccgatatcggtatgcaccgcataagcaaaatcgacaggcgttgcccctttgggcaaagttaggatttttccttttggcgtaaggatgtagatttcgttcggaaacaaatcgactttgacgtgttcgagaaactcaatggcattggcactgcttgcctgcaaatctaagatatttttcagccaccggtttgtgtgaagcaccgcctgatcgaccgtcttagaatatgatttatagctccaatgtccggcgattccaccttcggcaacagcatccatttccttggtacgtatctgaacttcaatcggcaagccgtaagggccgaccaaagtcgtatgcagactttgatacccgttgcttttcggaatggcgatatagtctttgaaccgcccgggcttgggctgatagagggtgtgcaatgcgccgagtgcggcataacaggctggaatgctgttgacaatgacgcggaaaccgtaaatatccataacctcggcaaagcgcagctttttcgccatcattttctgatggatgccgtacaggtttttttccctgcctttgattttggcctctatattcgcgcctaccagccgctggccgaatgcgcgcaagactttgccgacaacgtcctgccggttcttccggctcttgtccatcgctttttttaaagtctcgtagcggttgggatgcaggttttggaacgataaatcctgaagctcttgatatgcgttattcaaacctatacggttggcaatctgtgcatagatttcaagggtttcccttgcaatccggcggcgtttgtccgggcgcatcgaaccgagcgtccgcatattgtgcaggcggtcggcaagtttgacgacaatcacgcgcacatctttggtcattgccaaaatcagtttgcggaaactctccgcctgatgctccgcatgatcttcaaatttgagtttttcaagcttggacagaccgtccaccatctcggcaatcgtattgccgaacaccgccgccatttccccttttgtcacgcccgtatcttccaatacgtcgtgcatcacgcctgcacaaagaccctgtatgtccatatgccaaagggcgagctgcgtcgcaacggcaatcggatgcgtgatgtagggctccccgcttttgcgggtttgcccgtcgtgggcgcgaaacgcataggcgacagctttttcaagctccgcctgttcctcgggcttgaggtaggaggcggtatggaaaagcagggcacgcgcttcggcggtcagggggtcgtaaggggcggaaggttggggggcgggcatttcagacggctttcggtatgtatgtgtttttcatttcaaaccgtcggactgcacggcggcaaagtgttccggcgtgcgtttccggcagaatttatttattgcgcgtcaacagttctgtaccgatatgtccggcggcgatttcccttaaggcggtaacggtcggtttgttattgcggacatcgtccacaagcggcgtgttgccgttctcaagctggcgggcgcggcgagccgctaccaatgtcaggtcaaaatggttggaaatttttccggtacagtcttcggtggtaatacgtgccatattatttgctttctttcaaaaatatttaaattgggaaaccgggtattttcgccgttttctaggaattttccaacaaatctgcaataaaccccagttgccgcgaccttttcagacggcaggcattcacaatatggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttgattgatttggcaagcgacaggctgacggctacaatatggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctgaaaaccgaccctgccgtctgaaaccggcagggttgttatgatgcgttcaaatcacgcccaaatcttgcaagcccctcaacacgccgtcttcatcaacgctggggcaaacatatttcgccgcttctttcgccgcctgttccccgttgcccattgccacgccgaacccgacttctgacagcatttccacatcgttcaaaccgtcgccgaacgccatcacgtctgccatttcccatcccaatgcttcaaccacgcttctgatgccgtccgttttcgacgcacccgcaggcagcagatcgaccgcttcctcgtgccagcgcaccgttttcaagccttcccgttccacaatatccgaccaaagcggcatttcgttttcctccgcaaacaccagcatctgatacaccggtttgcttgaaaaataatccttatcggcaaaaaaatcgctggcgatatgcttcaaggcgcggcacacgcattccgacagcgcggacacagcgatcccctctccgccgacaaacgcataatccatgcccaagccatccaaatgcgcgcaaaccctgcccatcaaaccggcatccatcggtacttcgcgcacggtttttccgtgcagcagcgcaaactgtccgtttatcgttaccacggcatccattcccgcttccgccatcatatccctgaccttttcgggaatcgtcgccaaagaccgccccgttgccaacgccgtcaatatacctttgccgcgcaaagccgccaccgccgttttcacggaagggcgcaaagtatccgtatattttcggtacagcgtatcgtcaatgtcgaaaaacacgattttaggattcatcacattctctctcgcattcaaactaccgcattatatcccaagcaggcaaatacttgataaatccttataaatttcccgtcaaaattgaccgaaaatacaaaaaggcggataatccgcccatcctcaaacccttttcagacggcatttgcagcaatgccgtctgaaacatttttacaaagcatacaaatcatgtttcaacacacaggacgacacataaagcgtcgccctatatgttgccctgattcggaaggggttacgcccctcccaaataaagtctgattctactgccctaaagggcggggtttcaaccgaaaaggaaacacgatgaaagcacccgaactcttattgcccgccggcggattggaaagaatgcgcgccgcctacgactacggcgcagacgccgtttacgccggcagcccgcgttactcactgcgcgcccgcaacaacgaatttgccaaacttgatgttttagaacaaggcattaaagaagcgcacgagcgcaacaaaaaattctttttaaccgtcaacaccctgccgcacaattccaaactcaaaaccttcgttgccgacatggagccgctgattgccatgaaacccgacgcgctgattatggcggatccgggtttgattatgaccgtgcgcgaaaaatggccggaaatgccgatccatctgtccgtacaggcgaacaccaccaactattggggcgtgaaattctggcaaaacatcggcgtcgaacgcattattctgtcgcgcgaattgagtatggaagaaatcgccgaaatccgccaagaatgccccgacatcgaactcgaagtcttcatccacggcgcattgtgcatcgcttattcaggccgttgcctattgtcgggctatttcaaccaccgcgaccccaaccaaggcacctgcaccaactcctgccgttgggattacaaggttcacaatgccacggaaagcgatgcaggcgatgcccagcttctgcaaggtttcaactttgaaaaagcccaagaagaagccaaccaaaactttgaaggcatcaacggtcaaaaacgccatccctacgccgacaaagttttcctgattgaagaatccaaccgcccgggcgaaatgatgccgattatggaagacgaacacggcacctacatcatgaattccaaagaccttcgcggtatcgaagtcgtcgaaaaactcgccaaaatcggcgtggacagcctcaaagtcgaaggccgtaccaaatcgctctattatgttgcacgcgtcgcccagtcctaccgcaaagcgattgatgatgccgtcgcaggccgtccgtttgattacagcctgttgagcgaactcgaaggcctcgccaaccgcggctacaccagcggcttcctcgaacgccaccaaactcaggattatcaaaactacctgaccggccattccaccgccaaacaaagccaatacgtcggacacgttaccgaaatcgatgaaaacggctgggcaacagtggaagtcaaaaaccgctttgccgtcagcgattcactcgaaatcatccacccgagcggcaaccaaaccatcaaattggaacaaatgacccgcaaaggccagcctgtcgatgttgccccgggcaacggcattcaggtcaaaatccccaatatgcagggtaaagaaaaagccctcatcgcacgcgtgttgaacccctaagccattatgccgtctgaaacatttttcagacggcatttttaatccccttgccttattgtgcggcagattcagatcgggacacacctatagtccacgacagaagtctggcttttaagcgaagacaataaccgaaaagaccgcctcggcggtctttcttgtgtacacagtttttgtatttgtcagcttgatgcgttgacaactctaattccatattgcggaatatattcatcgacagtcatcagttcaaagccttccgcttgggtttgtgcaatcaacatcctatcgaaagggtctttgtgtatctccggaaggcttccagcctgttttgcatgaaacagacctataggcaacatttcaaaatcctcttcttgaagcacatcaaaaaactcttccggtaatttcaacaaccccttgttctgcttgatggaaatttcccaaatacttgctgcactgacaaagatcgcatttctcggattttctatcagtttgcgtgcagatatccccagtttcttgtcatccaacaaccaccacagcaacgcatgggtatcaagcagaatctttctcacagagccgactcctcaaaaaataaagctgccgtttcattgtcatcctcaagaatacgtgaaatatccgtattttccatatgactgaattttttcaaccttcctgcatttcgtgccggtttttcaataccgattagttggacgcaaggcttacctgccttcgcaataataacgatttcccctgcttctgctctttgaatcaattgactcaaattggtttttgcctgatgaatatttgcttgaaacataacacttctcatgattagctaacttgactaatatacatcattaccaagattttgggaatctcattacatatatttgattatatccgccgttttattcacaccttgctatttatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaaacggctttgcggtatcccagtttgacaccggttacttcctgattggtaagcatcattattttcccataaatcaaacgtctgacacggcattataaacacaatgcggcatctgccgccacccttgcggacgcggcgttaccggcttccacagctacttcgacaagcagccgctgcaaggcggacaatacgactgtcaggcaggctcgttccacgtccgcgtggtcatgcgcgccaacgtcgtccgttaacatatcggcaaccaaaaaatgccgtctgaaacatttttcagacggcatttttaatcctgcaacattaccccctgcctgagttcggatactgtatcaatataaaaccccatcacacagatttacggtaaaaagccgtccgaatgaattcttgaacacaattcggacggctttaattttcaacaaggcgattaattcaataataccagattaaaacttccattccagcgatacggcgtaattgcggcctggggcgcggtagcggtctaagcctttgccatcgcggtcgaccgcattggtggtgctgtagctatataaaccgcgcagggaatcccaagtggtgtatttgcggttgaacaggttgtacacgcctgcacgcaaagtcaggtttttagccggtttgtagaagccgtacatatcaaacacataagccgacttgttcagccacgggtaatcttttacctttttctgcaaaggcgtaccccagcccttgttttcataaacggtgtattgcgcgtctttgacctttttcgcgcctagataggtcaggcgggagaatacgccccatttttcgctcggactttcatagtcgataccggcaatcactttcagcggctgtgtggacagcaggctgttgtcgcccgacagtttgcttttcgcataacccagcgagccgaacagtttccaaccctcaggaacaaaagacgctactttgtccacattcagacggcctgtcagctcgataccgcggattctggccttgtcgatatttttcatctgccaatccagtttttctttgtaggggtcgctgcatataccgtagtaagcattttcctcagtacagccgggagtgccgctggtggtcagcttctgctcttcagacaggaaattgcggtaattgctttgatacaggttggcatccagcatgcctttttcgctgcggccttgcagagacagggtgtgggtggtgctgcgctcggctttcaggttgggattgggcagccaattacccgaaccgtggttgtaagtgaaatacacttcggacgcattggggacacggtagccggaagtaatgtcgtaaccgacacgccaagcctgattcagttgcgccgccaagccgacaaaaccgctccagcctttataagtgttggctgcaggtggtgttttgtcacaagcatgacactcggcattcaattcctgaggcgtcattttggtgtggtcgtaacggatacctgcgcggctactgaacacgtcgttccattgaatttggtcagacagtgagaaaccgtagttggtggttttcaccggatgctggatactgctggtggttcgaacaacacggccgctgaagtaataatcgtcgcggtttaggttttcaaaatcacggcggctgacgaaagttttaaacgacaggcggtgtcgcccccccccgagttgcaacggatggctgtccaaacgcaaagtaaaacgtttgaatcgggtgtccatgctgcggttgtatatttcgtccaaatccttctgattatagttgcgcgtccaggtggaataatccatcgggaacgagcctttgttgttaaccgccgccactttggttttctgataatcgaagtccgccttcaaagacgacaaccaatttgaatcaggcatccattcgtaaaagaggttggcattgcgccgtctgtttacgtcatcggcttcgcgccaggaagaagcggtcaggttataagactcttcaaccgtgtaattatgtccctgctggccgttaagcgatgcgccgatgcggtggttatcgttaatttggtaagcaatcttacccaaaaagctgtggtatttgtgtttggacgaatcagggataccgcgtgccgaaccacggatattcgcgccactgccttccccttccacagcatagcctcggtttcccgcactttcggtttcatgaccgcgacgttgcgaatacagcaaagcagcatccacgcggtcgttactcacaccgaaaccgagagtatttgtccattcacggttacgcgtgctgtaaccgtttttcatcatcacgccgaattgcctgtcgtccaacagcaaatcacggccttgcagcgtttggtaattcacaccgccgcccaatgcaccactgccggtattgaaagagtctgcgcccttcacgatttcgatgttgcgcacgagttcggggtcgatagacaaacgcgagctgttgaagttgccataacgggcgtacagcgagttttcttcagaatcaggcaggtttacaccgtctatgctcacgccgacacggttgccttccacgccgcgaacagcaaagcctttttgatggcggccgctgtcgctcaagccgacatcggtggaatagcgcaccaagtctttattgtcgcgtatcatttcttgtttgatacggttaaggttgacgcgttccacagccgcaggcgcattgcgctgacctttaacgcgcactgcttttatctctgccttaacgggtgtggtttcagttgcagcttcatctgctgccaagaccggattgccgaaaatactgccgaccagcgcggcgatagggagcatttgtaatggtttcatattatcaactcaagatgtatggattgttcatccatcggttagcgaataatagattttatgataatcattaatatttaataagacagtaatccatgtaaacaaagccgcgccgtgtaattaaaggtccctgcaaacagctatgccgagaccttgtttatttggttcgattcttgtttatttggttcgattattttttagtgcctgtgcggcatcattccttccggtgcttcggcatcggctgccaagccgaaggtttcgcgcaacacgactttgtagaatgcaaaggcttcgcgcgcgccttggatggcttccgcttcggcttcgggagtcaggttcaaagcgttcagatgctcgacgaaagcgcgccagtgtttgccgcgcccgtcgggatggggtgcgaggtggcgcgcgccgtgttcgccgttgtaatcgagtttttgggcgtgtttgaacaaaaatgccgcgcccaaattggatccttcggcgcaataaagccagccgattgctttgttgccggtttcatgcggcagcggtttgccgtattcgtaaggtttgtcacccaaatctgcaaggtcttgcgttacggcatcgtatcgcgccatgtattccagctcgggaatggctttgtttaattcggcatctttatagatgtggtcgacagccttgtggaaaacggattggagtttcaaaaatttgatgtagttttctttgctgacaaacggttggacagacataacgaggttatccacgctgtcgtgaaccgccgtggtatccgccttcaagcgtttggcaaatgtcaatgcttgattttcggtttcactcatattttttcctttgtcggtaagggataaggatgcggtgcgggcaaaatccgcacttgcccgcatatatagtggattaacaaaaaccagtacggcgttgcctcgccttagctcaaagagaacgattctctaaggtgctgaagcaccaagtgagtcggttccgtactatttgtactgtctgcggcttcgccgccttgtcctgatttttgttaatccactataaaaataataaagaatcataaacgaaatttattatcacatatttttggaaaaaatatcatttgcgtgatgtttttaagcaggtattttactattctttacagaatcgggattttatcaaatgggttcggcagtcggcggacaaccgctcaaaaaatatttttgccggacaccaagggtttgttcatactgccgaacctgccggttttgcatcctgattgggtgtatcgccttttttcctttataatgccgccacttatatttgccactttcccgatgaagccgtttgccgaaaatatcccccacagccttcgcggcaactgctgcgacgaagccctgccgccgcatacggtagattgtccggaatgcggctgccgcgcggatgtaccccggttggacagtggagaagcggcgttctgtccccgttgcggacacaaactcttcagggtgggcaggcatcctttttccgccccgcccgcctatgcggcggcttcgctgattttaatggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcgggccggcgttttatctgatgttcgcgctgtcagttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaattttatggtcgggcaagtcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgacgaccgctcgctgtactacaccgcgtttttcaaacaatccgtgcgcggcctgaccgtcggttcgcccgtcgagtacaaagggctgaatgtcggcgtggtttccgacgttccttatttcgaccgcaacgacagcctgcacctgtttgaaaacggctggatacccgtacgcatccgcattgaaccttcccgtttggaaatcaatgccgacgaacaaagcaaagaacattggaaacaacaatttcagacggccttaaacaaaggcctgaccgccaccatctccagcaacaacctgctgaccggaagcaaaatgattgagttgaacgatcagccttccgcatcacctaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgccgcaatcgcctatctacggcgacgtacaaaatacgctgcaaagtttggacaaaactttaaaagacgttcaacccgtgattaatactttgaaagaaaaacccaacgcgctgattttcaacagcagcagcaaagaccctatcccgaaaggaagccgataatgcgccttttcccgattgccgccgccctgtcgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgcgatgaccgccgcactcgaacagggactgaaacaggcggcgcaacagatggtcgagtaaaccgtgaactattgcgaatttgccgcctcacttcccgaaaacaccgataacccgaacaaacattaccacgacacgcaatacggttttccgattgaggacgacaatgaattgtttgagcggctggtgttggaaatcaatcaggcaggattaaactggacgctgatgctgaagaagcggcaggcgtttcagacggcatttgaaggtttcgacatcgatacggttgccgccttcgacgacaccgaccgcgaacgcctgcttgccgacgcgggcattgtccgcaaccgcctgaaaatcgatgccgccattttcaatgcacggcaaatccaagcgttgcaacaagaatacggctcgttcaagaactggctcgacacgcaccatccgcgaagcaaagacgaatgggttaaactctttaaaaaacatttcaaattcgtcggcggcgaaatcgtcggcgaatttctgatgagtaccggctacctcaaaggcgcgcacgccgaaagctgtccggtttaccgtgaaaccctgaaataccacccgaaatggctcgatgccatctgaaaaaccaatgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataaacaaaggtttatccgcacccaagttgtttatataatcatgaaccgactgggacaccaaactgcttcgggacgcatatgccgtctgaagtgcaaagcctacgccatacagccgcatgaagttgcagcggtatggcgttttttgaaaaagacggcctgccggttcagacggcatgaccgaccgtccgagcctgctgtggataaagcccggacaggctgaaatcatggaatattgcgaacctgaagaagcatccgacccgtacgcaacatacaggcgtgccaacctgatggcgggtctgccgctgtttgtcgtgattttggttctgctcaatattgtttttccgcttccggcgcatcccttagcttggctggtgcctgcaggtttcatggttttgggcggcggctttcccttatcgctgccgcttgtggcgctgcttgtcctgacctgctgcattctggcgcattgtccgccattatcccgtcttttgtgctacccttgcccgaatcatccgatgtctaaaaattctgcctgatggcagccctacaaacccgaaggagtagaaatgaaactgtccgaactgttcaaccccgacgaatttgccgcgcggcatttgagttttggcgacgaagcggcgttgcttgccgctgtcggcgagaaaagtatggacgattttgtcggcaacaccgtgccgcaaagcatccgtatgccgtctgaactcgatttgcccgatgccctgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaatcgcgcaggtcgtttggaagctttgttgaacttccaacaagtgtgtatcgatttgaccggtttccctgtggcgggcgcgtctttgctggacgaagcgaccgccgccgccgaagcgatggcgatggcgcaccgcgtgggcaaggtaaaatccgagcgtttctttgtggacgagcgcgtgtatccgcaaactttggacgtgatgaaaacccgtgccaagtatttcggcttcgagctggtggtcggcgattttgcccaagccgacgaaggcgaatacttcggcgcgctgttccaatacgtcggcaaagacggcgacgtgcaagacttgcaggacgttatcggccgtctgaaagccaaaggcacgattgtcgccgtttccgccgacatcatgagcttggttttgctgaaaccgcctgccgaattgggtgcggatattgcgttgggcaacacacaacgcttcggcgtgccgatgggcttcggcgggccgcacgccgcttatttcgcgtttaaagacgagttcaaacgttccgccccgggccgcatcatcggcgtatccaaagacgcatcgggcaaacctgccttgcgcatggctttgtccacccgtgagcaacacatccgccgcgaaaaagctacatccaatatttgtaccgcgcaggcattgctggcgaatttggcgggtatgtatgccgtttaccacggccctgaaggcgtgaaacgcattgccaaccgcattcacgcgctggcttctgcctttgccgatgcgctggtttcagacggcctgaatgtggttcacaaagtctttttcgatactgttaccatcgattttggcagtaaagagaaagcagaccaagtgtttgccgctgctttggcgtcgggttacaacctgcgccgcgtcaacgatactcaagttgcggctgcattccatgaaacatcggcatacgaagatttggtcgatttgtaccgcgcgtttaccggcaaggatacgtttacatttgccgatgatgtcaaaggccgtctgaacgccgaattgctgcgtcaggacgacattctgcaacatcctgtgttcaacagttaccacaccgaacacgaaatgttgcgttatctgaaaaaactcgaagaccgcgacttggcgatgaaccgcagtatgatttcattgggcagctgtactatgaaactcaacgcgactgcggaaatgttgccgattacttgggccgagttcaccgacatccatccttacgctcccgaagcgcaaaccgccggctaccgcgaattgctcgccgatatggaaaacagcctgaaagccatcaccggctttgacgcgatttccctgcaaccaaattccggcgcacaaggcgaatacaccggtatgctcgccatccgccgctatcaggaatcccaaggcgaagcgcaccgcaacatctgtctgattccaaaatcagcccacggtaccaaccccgccaccgccgccatgctcggtttgaaagtcgtcgtcgtcgacaccgacgaacacggcaacgtcaacattgacgatttgaaagccaaagccgagcaacaccgcgacgctttgtctgccatcatgattacctatccgtccacccacggcgtgtacgaagaaggcatccgcgacatctgccgcattattcacgaaaacggcggacaggtttacatggacggtgcgaacctcaacgcccaaatcggcatcatgcagcctgccgaagtcggtgcggatgtgttgcacatgaacctgcacaaaaccttctgtatccctcacggcggcggcggcccgggcatgggtccgattggcttgaaagcccatttggctccgtttgccccgggccataccttgaccgacacccacaacgcggctgccgatcaaaccgccgtggctgccgcagcatatggttctgcatccatcctgccgattacttggatgtacctgaccatgatgggcaaacaaggcatggaacaggcaacgcgctgggcattgctcaacgccaactacgtcgccaaagccttgggcgaggattatccgattctctacaccggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccgccctgaaacaaatcaaacaggaagtgctgaaagtcgggcgcggcgaatggccgaaagacgacaacccactggtcaacgcgccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactgactgttgatatcttaaaaaatgccgtctgaaacattttcagacggcattttcatcaacggcaaaccagttgcaccaatacacgtatctcgactataactttaaaacaaatgagttaaaccagtatccatacatcagcttttttatcatcctactttttattcatccgatcgtgcaaacagatttcaaagatgaaaagcctattcacaccctttgatgtcatttccacacggacaaacaaatatagtggattaacaaaaaccagtacagcgttgcctcgccttagctcaaagagaacgattctctaaggtgctcaagcaccaagtgaatcggttccgtactatttgtactgtctacggcttcgtcgccttgtcctgatttttgttaattcactataaattcccataaaaaaacggagcagatacctgccccgtttttatttaatccgaaattttaatctaaatttagaattttgcaccggattggtttgccatatagtcaacagccgctttgacttcgtcatcgctcaaacctgcattgccgcctttggcaggcatcgcgttaaagccttcaagggcgtgtttgtgcaaggtttctttgccttttttgatacgcggtgcccaatcgtcttttttgcctatgccgggaataccgggaatcgaaccgccgtggcacacctgacaggttgcttcgaagacttttttaccgtcaacgccgaccgcaggggctgccgcacccttgtcttctgccttcgcttctgccggagctgcactatcggcaggagcagaagctgttcctgaagcggcattgtcggcaggcgcagcctcatcaggattcgggaaagaaccgccgcttttgttcgccatgtaagtaatcgcccgtttaagttcctgatcggtcaggtctgccgcaccgccttttgcaggcatggcgttaaagccgttcagcgcgtgttggaacaaggtatcgaagccttgcgcgatacgcggtgcccaatcgccgttgtgttccagtttcggagcgttcggcacattgctgtccgccgcgtggcattggatacagattttgccgaaaatctgttcgccttggcgttcgccgacggggatgccgtcgcccatcgtcaattgtccgacaggctggatacgggtctgcgttgctgcttccgtagtggcatcgacatcgccgaacgagccgctgcccgccagcttaatcaggaaataaaggactgcaataacaataacgataccgctcacaagggtaaacagtgcagagccttgggctttgttgtcgcggagttgtttcatttggtaggcctcgccgtcaggttaggttgtgctgtaaattatagtttggtgtgttaaacgcagttaacaatattttgctggattatactgaattcacagggtctttccaatcgctatcattgaaaatatgaaaaaatttgccaacggtatctgtataaaacaaataatcctttgaaaataattgtttatcctcaagaaaactctccttatgccgccatacgccgcctgccggcgcaagataacctttgccaatttgcagaatttacgttaaccttgcgttttccgcacccatagctcagttggaagagtgtcagtttccgaagctggaggtcacaggttcgatccctgttgggtgcgccaattataaagagaccgtctgaaagataaatatttttcagacggtcttttgacttacttcaaactcttatttcaagacttccgcaaatgcgcgggcaacatagtcggtattcgacgtattcagtccggcgacgcacatcctgccggaatccagcaggtaaacggcaaattcgtcgcgcagcctgcggacttgttccacgctcaatcctgtgtagccgaacatgccgcgctgtttgatgaaataagtgaaatcgcgattggggatttgcgcagttaagacatcataaagtttctgccgcatcgcacggatgcggtcgcgcatcatataaacctcgttttgccacaaggcgtaaagttcggggctgttcatcacgtcggcggcgatatacgcgccgtgcgcgggcgggctggagtagatgcggcggacggtgaatttgagctgtccgaacaccaaatccgcttcttccttattcgggcaaaccacgcttaagccgccgacgcgctcgccgtagagcgacaggttttttgagaaggaattgctgacgaacaagggcaattccatttccaccgctttgcggacggcgtaggcatcgctgtccaaatcgccgccgaatccttggtaggcaatgtccataaacggaatcagtttgcgcgttttgatgatgtgcaacacttcgtcccattgccgttccgacatatccacgccggtcgggttgtggcagcagggatggaggatcaggacgctgttttcgggcagggtgttgaaaaacgcggtcatttcgtcgaatttcacgccgacagtggcagggtcgtaatatgggtaagtgccgacctcgaaacctgcgccttcaaaaatgccgcgatggttgtcccaagtcgggtcgctgacgtaggcgcgcgcttcgggaaaccagcggtgcaggaagtccgccccgactttgagcgcgcccgagccgcccaaggtttgtacggtaacgatgcgcccttgcgcaagcgcgggattgtctttgccgaacaataaatgctgcaccgcgctgcggtaagtgtccaagccttccatcggcaggtagggcgacggcgcaggcgcggcggcacgggcggtttcggctcggctcacggattccaacacgggcattttgccttcgtcgtcgaaataaatgcctatgctcaaattgactttttcggggcgcgggtcgtttttgaaggtttcgaccaaactcaaaatcgggtcgccaggatagtattcgatgtgtcggtacatagtccttacctcttgctttttcaaaggattttctttttcaacaatacaccactttcgatatggtgcgtaaacgggaattggtcgaacagggcggcacgttcgaccgcatgggtttccgccaaggtgtccaaattggcgcgcaacgtttcgggattgcaggaaatgtagatgatgttgtcaaactgcgacaccagcttcaaagtttcctcatcgataccggcacgcggcggatcgacgaaaatagtggaaaatgcgtaatccgtcaaagcaataccgccatccttaaggcgtttaaactcacgttttccggtataggcttcggtaaattcttcagcagacagacgggcgattttgatgttgccgatgcggttggcttcgatattccattgcgccgcgctgacggaggttttggagatttcggttgccaaaacctgtcggaaatatcgggacagcggcagggtgaaattgccgtttccgcaatacagttcgagcaggtcgctgcccaagccttccgccgtgcggcacgcccattcaagcattttctgacacacggcggcattcggttgggtaaaactgccttcaatttgccgataacggaaatcccggttgccgaccttcaaagtttccgttacatagtcctgttttaagactattttctgtcccctgctccgcccaataacggaaatatccaactgttgctgtaacgcttgcgccgcctgcatccactcagcatcaagccttttgtggtaaatcatggtaaccagcatttccccgctgagcgtggacagaaattcgacggcataccagcgttttttgagttcgggggattgcgcggcggcggcgatcagctcgggcatgaggcggttgacagcctcggaagctgcttcaaaacggtcgcagcgtatcatgcttgcgccgctggctttctgccctttttcaaacatggcataaaacatttccccgccttcgtgccaaatacggaactcggcacgcatacggtaatgtttgtccggagattcgtacacttcccactcaggaacatccaaacctgcaaaaagggttttaaggtagtcttttttaccttgaagctgctgcgtgtagtcattcatatcgctatcctgaaaaatcagaccggattataagccgatttgcctcgccgcacgcaaactctttgactgccgccccttcaatgacggacgggcttttgtgctaaaatccgccatctttccacactataccgataaagggaaaaatcatggcaggcaacactttcggacaactcttcaccgttaccaccttcggcgaaagccacggcgcgggtttgggctgtatcatcgacggctgcccgcccggcttggaattaagcgaagcggatatccaatttgacctcgaccgacgcaaacccggcaccagccgccacgttacccaacgccgcgaagccgaccaagtcgaaatcctctccggcgtattcgaaggcaaaaccaccggcacgcccatcgccctcttaatccgcaataccgaccagcgcagcaaagactacggcaacatcgccaccagcttccgccccggccacgccgactatacctattggcacaaatacggcacgcgcgactaccgcggcggcggcaggagctccgcccgtgaaaccgccgcccgcgttgctgccggagccgttgccaaaaaatggttgaaagaaaaattcggcacggaaatcaccgcctacgttacccaagtcggcgaaaaagaaatccggtttgaaggctgcgaacacatttcccaaaatcctttttttgccgccaaccatagccaaattgccgagctggaaaactatatggacagcgtgcgcaaatccttggattccgtcggcgcgaagctgcatatcgaagcagccaatgtccctgtcggcttgggcgaacctgtttttgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccactcaggcggcatcctcggcggcatcagcaccgggcaagacatccgcgtcaatatcgccatcaaacccaccagctccatcgccaccccgcgccgcagtatcgacatcaacggcaaccccatcgaactcgccacgcacggcaggcacgacccctgcgtcggactgcgctccgcgccgatcgccgaagccatgctcgcgttagtcctcatcgaccacgccctgcgccatcgcgcgcaaaatgccgacgttcaggttaatacgcccgacattaccctttcaaacaaataaaaatttagccaaaacacagactttataatagaatatcgagcattgccgtgcagccttgacgcacgggtttgtttagaggaatacaaccgaaatgacacaagaaaccgctttgggcgcggcactaaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgatgccgcactgattgcacgcgtcctcgccaaccactgccgccgtccgcgctatctgaaagccttggcgcgcggaggcaaacgtttcgatttgaacaaccgtttcaaaggcgaagttacccccgaagaacaggcgatcgcgcaaaaccatccttttgtgcagcaggctttgcaacagcagtccgcccaagctgccgccgaaacgctgtctgttgaagccgaagcagccgaatcttccgcagcagaataaatccccaaacgaaatgccgtctgaaaaccgatttggtttcagacggcattttttcgtatgcggcaatcacggttcaaatatccaattccgccgtatcgccttcgcgttccatccaagcgcggcgggcggcggcttcgcctttgcccatcagtttgacgaagatgtcgcgcgtctcgtcatctgcaccttctgggatttgtacctgcaacaggcggcgggtgtcggggtgcatggtagtatctttgagctggtcggggttcatctcgcccaagcctttgaaacggctgatggaataggcggtttctttaacgccttctttttgcagccgctccaaaatgctgtcgagttcgttttggtcgagggcgtagaatttgcgggcaggtttgctcttaccttgtgcgttgacatcgacgcggaacagtggcggctgggcgacgtagatgtgtccgtcggcaaccagtttcgggaagtggcggtagaacagggtcagcagcaaaacttgaatatgcgagccgtccacgtcggcatcggacaggatggcgattttgccgtagcgcaggccgcttaaatcgggatggtcgttaataccgtgcggatcgacgccgatggcgacggaaatgtcgtggatttcggcgttgccgaagagttggtcggggtggacttcaaagctgttgagcactttgccgcgcaggggcaggatggcttgggtggctttgtcgcgggcgagtttggctgagccgccggcggaatcgccttcgacgaggaagagttcgttttcgcggatgtcttcgctttcgcagtcggtcagcttaccgggcaggacggcgacgccgctgccttttttcttttcaatctttttaaccgaacgcatccgcgcctgtgcttggcggatggcgagttcggcgatttttttgccgaagtccacgttttggttcagccacaattccaaagggtcgcccgatacggtggcgacgagtttcagcgcgtcgcggttggtcagcttgtctttggtttgaccttggaactgcgggtcgaggacgcgggcagagagaacgaaggcggtttttccgaacacgtcgtcgctttgcactttaacgccgcgcggcaagaggttgtgcagattgatgaagttgttgactgcgttgaacacggcttgtttcaagcctgcttcgtgcgtgccgcccagcggggtggggatgaggttgacgtagctttcgttggcgcacgagccttcttccagccaagtcagggcaaacgccgctccttcgccgatgctgaaatcgccgttgtgttcgtctgaaatgtagttttcgcaagagaacagcggtacggcttcctgcgcgtcggcaatcaggtcggtcagatagcttttcaggccgtcggggtaatgccaggtttgggtgtgcgcttcgtcttcgcctttgaccggacgggtcagggaaacgcgcacacccggcagcagcacggctttggcacgcagcaggcgttcgagttcgggaatgctgtaattcgggctttcaaaatatttgccgtccggccagacgcgcacttctgtaccgctgtctttgacggcgcatttgcccacttgtgccaacggttcgaccacgtcgccgccggcaaacacgatgcggtggattttgccttcgcgtttgaccgttacttcaaggcgggtggaaagggcgttggtgacggatacgcccacgccgtgcaggccgcctgaaaaggcatacgcgctgcctccgtcttttttgttgaacttgccgcctgcgtgcagacgggtgaatacgagttcgactacggatacgccttcttcgggatgcaggccgacgggaatgccgcgcccattgtcgtgcacggaaagcgaaccgtcttcatgaatttgcacgtcgattgcagtcgcgaaaccgcccaacgcttcatccgacgcgttgtcgatgacttcttggcagatatgggtcgggctgtcggtgcgggtgtacataccgggacgttctttgaccggctccaagcctttgaggacggtgatgctggattcgctgtattggttgtttttagccatgggaataatctgaaagtaagaaaaacaacgctttcagacggcctgaaagcgttgcgttccgttgttttagcggttgtcggaagattggcgggcggcaaagtcttcataactttccataccgcgcaggaagcgggaagagagttctttcaacgcccccaaataaacgtcgcgtttgaaatcaatcacttcgtcaacgggtgcccaatattgatgccaacgccagccgtcaaattcggggtggcgggtggcgcgcaggttgacatcgcaatctcggccggtcaggcgcaggagataccaaatctgcttctgtccgcgataagagccgcgccattcgcggcgtacccagttgttcggcacgtcataacgcagccagtcgcgcgtgcggccgataattttgacgtgttgcggcaaaagcccgacttcttcgtacaactcgcggtacatggcggtttcggggctttcgcccggcttgatgccgccttgcggaaactgccaagaatgttcgcgcacgcgcttaccccaaaagacttcgttgcggttgttgattaagatgataccgacattggggcgatagccttccctgtccaacacggtgtcgccctccgttaaattcaatcttgggattttcccacaaatcaggcggttttgacaaatcagacggcatggcggtacgcgtgccgaaacacggggggatttgggaaaatatcttaaatttggtttacaataatgtatttcaaattattcgggaatcagaccatgttagatatccaattgctccgcagcaacaccgccgccgttgccgaacggcttgcacggcgcggttatgactttgataccgcacgttttgacacactggaagaacgacgcaagtccgttcaggtgaaaaccgaagaattacaggcctcgcgcaacagcatttccaaacaaatcggcgcactgaaaggtcagggcaaacacgaagaagcgcaggcggccatgaatcaggttgcccaaatcaaaaccgatttggaacaggctgccgccgatttggatgccgttcaaaaagaattggacgcatggttgttgagcatacctaacctgccgcacgaaagcgtacctgccggtaaagacgaaaccgaaaacgtcgaagtccgcaaagtcggcaccccgcgcgaatttgactttgaaatcaaagaccatgtcgatttgggcgaacctttgggtttggattttgaaggcggtgcaaaactctccggcgcacgatttaccgtgatgcgcggacaaatcgcccgtctgcaccgcgccttggcacagttcatgctggatacgcacacgctgcaacacggctacaccgagcattacacgccttatatcgttgacgatacgacgctgcaaggtacgggccaactaccaaaatttgcggaagatctgttccacgttacccgtggcggcgacgaaaccaaaaccacccaatacctgattccgacagccgaagttaccctgaccaataccgttgccgacagcattatcccgtccgaacaactgccgctgaagctgaccgcgcattcgccctgtttccgcagcgaggcgggttcgtacggcaaagacacgcgcggtctgattcgccagcaccagttcgacaaagtggaaatggttcaaatcgttcatcccgaaaaatcatacgaaacgctggaagaaatggtcggccatgccgaaaacatcctgaaggctttggaactgccctaccgcgtgattaccctgtgtaccggcgacatgggcttcggcgcggcaaaaacgtatgacttggaagtttgggtgccggcgcaaaatacctaccgcgaaatctcaagctgctccaactgcgaagatttccaagcccgccgcctgaaggcgcgtttcaaagacgaaaacggcaaaaaccgcttggtacatactttgaacggctccggcttggctgtcggcagaacgctggtcgccgtattggaaaaccatcaaaacgccgacggcagcatcaacatccctgccgcactgcaaccgtatatgggcggtgttgccaagttggaagtcaaataagtttgcaggctgcctgaacgtcaaatgccgtctgaaacctgtttcagacggcatttcctttaaacttttaaaacacgtcagccgtcggcacgaaccgcattgccgcaatcgccggtctgtccgacctcgcggatattggacagcgtaacttccgaaatattacccaacgcctcttccgtcaaaaatgcctgatggccggtaaacagcacattatgacaagacgacaggcggcggaacacgtcgtcggtaatcacatcgttggatttgtcttcaaaaaacagctcgcgctcgttctcgtacacatccatgcccaatgcgccgattttccggcgtttcaacgcctcaatcgcggcggcactgtcaatcagcccgccccggctggtgttgataatcatcacgccgtctttcattttgtcgaacgccgcttcgttcagcatatagtggttttccggcgtggcggggcaatgcagcgtgatgatgtccgaccgggcatacagctcgtctaaatccacatatttgccgccgattttttccgcttcggggttgcaaaacggatcgtaagccagcaggttcatgccgaaaccctttaaaatccgcatggttgcaataccgattttccccgtgccgataacgcccgccgttttgccgtacatattgaaaccggtcagaccttccagcgaaaaattcgcatcgcgggtacgctgataggctttgtggatacggcggttcaacgtcagcatcagaccgaccgtatgttccgcaaccgattcgggcgaataggcaggcacgcgcacgactttcaagcccaactcttcagccgcctttaaatccacattattgaagccggcacaacgcaacgccacagttttcacgccaatttgcgccaatttttccaacacgggccggctgccgtcgtcgtttacaaaaatacagaccgcttccgcgccttccgccattttcgccgttttcgcatccagcataaaatcaaaaaactccagctcgaagccgaaatgccggttggcgcgggtaaaatgttcgcggtcatagcttttcgtaccgtaaatcgcaatcttcatcaatatgtccagttgtcgtctatggttgagaaacggcataatacactgaattcaaacaaatcagtagaatatggtggattaaaattgattgcatgcacggcatttccatttcaaaacacaaaactcaatcgcccattgccgccagaagctcggcctgatgctcggcaatcagggcattggtgatttcttccaagtcgccgtccatcacaaaatccagcttgtgcagggtaaggttgatgcggtggtcggttacgcggccttggggatagttgtaggtgcggatgcgttcgctgcggtcgccgctgccgatgagggatttgcgctcggcggcttctttggcttgggcttcgcgtttttgcgcgtcgttcaggcgggcggcgaggactttcattgcctgcgctttgttggcatgttggctgcggccgtcttggcattcgaccaccatgccggtgggcaggtgggtgatgcggacggcggagtcggttttgttgatgtgctgaccgcccgcgccggatgcgcggaaggtgtcgatgcgcaggtcggctgggttcagttcgatgtcttccagttcgtccgcttcgggcatgacggcaacggtgcaggcggaggtgtggatgcggccttggctttcggtggcggggacgcgctgcacgcggtgtccgcccgattcaaatttcaaacggctgtacgccccgagtccgacaatacgggcgatgacttctttatagccgcccaattcgctttcgttggcggacacgatttcaacctgccaacggttgcgctcggcgtagcggctgtacatacgcagcaaatcgccggcaaacagcgcggcttcgtcgccgcccgttccggcgcgtatttcgatgaagatgtttttgtcgtcgtcggcatctttgggcagcagcagtttttgcagttcggtatcgagttcgccgattttggctttggccgcttcgatttcttcggcggcaaagtctttcatttcggggtcggacaacatttcttcggcatccgccaagtcgctttgggcaagccgatagttttggaacacttcgacgacgggggtcagttcggcgtgttcgcgcgtgagcttgcggtagttgtccatgtcggacgtggcttcgggctgtccgagaaggtgggtaacttcttccagtcggtcgctgagttgttgtagtttttctaagatagacggcttcataattcttccataacaaacgccgcctgaatgttcagacggcatcaacactggattattataataggttttccggatattcaaaaagataatcttagatggataacctaccgtcccaacagggcatcggcattgcgctccgttacctttgcaatctcttctacacaggttccgcggatttccgcagcaatctttgcaatacccggaatattggcaggcgtattaatctcttttttcagcataaacgggctatccgtttccaatacgaaatccccgtcgttcaaggctttaagcgtatcgcgcactttacgcgcgttcggattgagcagcagcgaaccgatgccgattttgaaacccagtttcgtcaacacacgcgcttcttccgcgctgccggagaaggcgtgaacgatgccgccttgggcaaagcctgtctgtttgacggcggcggcgatgtcggcggtggctttgagattatggataatcacgcggcggcgcagggtttgcgcaatttcaagctggcggacgaaaacttgaatttgccgttcgcgctgctgcgacgtttgggttttatcgtaaaaatccaagccgatttcgccgacccatgcctgcggataatgtgccaacatcgtttccaggcggacgaaatcccgctcggcaatgccgtctgaaaaccaaggatgaatgcccagtgcaatacggatttgaccgtgttcggacggcatttccgccaaatccgccacgtcctgccaatcctgcgggcgcgtcgcgggaacgataaaccgcttcaccccaactttccgcgctgcggtcaggatgtgcggcaggttttcgcgcagggcgggatcagcgagatggcagtgggtgtcggtgaagttcatttcgatttcacactaactttagtcttaccaattctttgtaaacatcttccttaccccagccttgcgatacggcgagggtcatcagcgcggtggcggtttcgaggttgcatttgccgccgttgatgatgcccgagttgcggaacgcgttgccttgcgcgtaaacggcggcggttttgccttgtcggacttggctgatgttgagcagcagtttgccctgccgcgcgaagtctcggacggcgcggataaaaccttcgtctgcgggcgtgttgccgtgtccgtagctttgcaggataagagcttgggcgggaagctgtccgagtccgtccgcaagttcttggacggcaaagccggggataagcgtgcggacagcgatttttgcctgcgggtcgggataacggattttgaggccgtctgaaacggctgctgcgtcttgggacgggaggcgaagattgtgccaaccccgggtttcgtcccattcggcaagcgtgccgaaatgcggattgtcgaagcctgcagcagtttcggtgctgactttgctgctgccgacggcgggatacagtttgccgtcaaacgcgatgacggtttgtttgagcttgaggctgaaggcggcaacggcggtggagaggttgcgcggggcatcgctgttttcggcggcgtaaggccattgggaaccagtcaggacaatcggtttgcccaaaccttgcagagcgagcgcgaggagattggcggtgtacgccatgctgtccgtgccgtgcagtatcaggatgccgtcgcatgaagggagtttgtcggcaatgatgtccagccaatcgcgccagtgttgcagcgtaacggaggaggaatcaatcaagggattgcagacgtgccactcgaaatcgaggccgtctgaaaagggggaaagggcttggctaaccagtgcggtatcggggcgcaggccttcgctgctttgggtcatgcctatggtgccgcctgtgtagaggacgaagattttttgtttcatggacatcatcgggtcgtctgaaaataataatacggcttatttaactatatttcggacagactggcaatttggcggcgcggacggttttcagacggccttcaaatgaaaaagcacccgagggctgtcgatatttgattttccaagtagatttttattcacgaaataggagagccgcaacaagcttaaatcccttgtgaggttcccaacacggaagataccgctttgtggattaaaaaatacggaaactattgaatatcgacaacctatttaggtgcttgattttattgtttgctttgcgcggcttttttggctgccttggcggctttgcgttgcgcccgcttttctttcaatttgctgcggtaaaactggatacgttggcgttttttccaccaaatccaagcgacaacggtcgcacctatacccaagataacaaaaatacccgattgcaggctgtgcattttcgccatcagccaatcgatgttgtgcgcaccgtattcgcccagataaatccaaatagggacggaaatcagtgcggccagtccatccataatgataaaacgcaagtatgaaaccttgcggctgataccggctgtaacaaatacggccgttctcaaaccgggcaggaaacgggcgacaaataagacccagttaccgtatttgtcgaatttttcctgaacctgctcataacgtttcggcgtcatgatgcgcgcaataggtttgaaccttaggattttctgcccccaaattcgtccggcggcgaacatgatgccgtccccgaccaatacgccgagcataccgactgcaaacataatatgcggattggtataacccatacccgaaatcacgccgcctgttaccaaggtcaaatcctcgggaatcggcacgccgaaaccgcagatgaccaatacaaaaaaaacagccgcataaccgtattcgacaaaaaaggcttctaaaaaagcaaacatggcggatattccattgtcggagataaaaagtcagaacaaaccgaaacattttctacatgaagcaggcattctatcaaagattatgccgtctgaaagcggaaaaaaggcagattcgcgcatcctccgcatgttcagacggcatttaaacagaaaaccggccggttctaaaaacggttttgcctgattttgcctaaatgccgccgatggcggcggcaatgcgttccgccccttcgcgcgcccaatccgcctgccgcgcctccaccatcacgcgcacgacgggttcggttcccgaagcgcgcaacacgacacgccctttgccttcgagttctttttccacttccgccaacacgtctttcgaagcttcctgccattgctgacctttttggatgcgcacgttaatcatcgtttgcggatacggctgccaatcggcgcaaacggtggcgaggtcttggttcagcgtttgcagtgccgccaaaacttgcagcgcggaaataatgccgtcgccggtgttgtgtttgtccatacacaaaatatggccgctggcttcgccgccgatgagccagccgcgttggttcagctgttccaacacatagcggtcgccgactttggcgcggcagaaatccacgccctgctctttcagggcgatttccatcgccatattggtcatgaccgtgccgaccacgccgccgatgttgataccttctcgggcgcgggctttggcaatgacgtaaatcaggctgtcgccgtcgtaaacctgcccgtttttatcgaccatcatcaggcggtcgccgtcgccgtctaaggcgatgccgtagtcggcttcatgctgtaaaacggcggcctggagtgtcttggtataagtcgcaccgcatttttcgttgatgttgtagccgttgggttcgttgccgatgctgacgacctgtgcgcccagttcgtgaaacaccttgggggcgacaccgtaccccgcgccgttggcggtatcgacaaccaacttcaaaccccgaaggtcggaatggctgggaaaggtggatttgcaaaattcgatatagcggtcgtccgcaccgctgatgcggcgtgcgcgaccgagacgggcggacggttgggttttcatttcgccgtcgattttggcttcgatttccaactcgacttcatcggaaagtttcacgccgccttcggcgaagaatttgatgccgttgtcggaataggcgttgtgcgacgcggaaatcatcacgccggcggacaggcgcaacgcgcgggtcagataagccacgccgggcgtgggcagcggtccggtctgtaccacattcacacccgccgccgtaaaaccggccaccaaagcggcttccagcatatagccggaaatgcgcgtgtctttgccgatgaggacggtcggtttctggtcggtgtcgtgctgcaccaaaacctgccccgccgcatagccgagtttcaatacgaaatcgggcgtaatcggaaattgccccacttcgccgcgcacgccgtccgtgccgaaatatttttttgccatgtgttgctccgagaatgtgaaccgttgtccgagattatacagtcagtttgtgccttgctgtctgcaccgttgatgccgtctgaaaccgccccgtccttttcagacggcatgaagtatgtgaaccgctgtttacagattgatgcccaacgcttcccacaccttcaacgcatccgctgtcgccttcacatcatgcacccgcacgatttgcgcgccgcgcgctacggaagccaacgctgccgccacgctgccgtgtacgcgttccgccgcatttgcctcgccggtcagctcgcctatcgtgcttttgcgcgatacgccgatgagcagcggaaaacctgtttccgccatcaattcgggcaaatgccgcatcagcgcgatattgtgttgcaagggtttgccgaagccggagccgaagccggggtcgagtatgatgcgttgcggtgcgatgcctgccgcgatacattccgctgagcgcgctttcaaataccgcgctacttcaccgacaacatcttgatatttcggattaatctgcatggttttgggcaaaccctgcatgtgcatcaggcaaatgcccgtgtccgcctgacgcgccagcaattcgaccgcgccctcgtcattcaacgccgccacatcattaataatatcgatgccgccgagtgccaacgctttttccataatcaccgtgcggcgcgtgtccaaactgatgggaacgccccaccccgccacttccgccaaaacaggctcaacccgcgcccattcttcttcaggcgaaacataatccgcacccgaccgcgtcgattcgccgccgatgtcgagaatgtctgcgccttcttttagaagctgttcggcatgtgccaaggctgtttgggcgttttgcgaatacacgccgccgtcggaaaaagaatcgggtgtgagattcacgatgcccatgattttcggtttgtccaaaccgatttcaaaccgtcctgcctgccaaacgtgtcgtgccatctgaactcctcccaaaataaaaaacagattatatgccgtctgaaaccgtcttgtgcgcttcagacggcaccgctattcgggcggcagacggcatgttgtccgaatgtctgctccgcctttgaatctgccggtatgcctgctatccgcccgacttttcaaaacaggttccgacgattccgcacgcgcctgccgcctttgccaagccgtacaggatttcctgcggcatatcgcggttccataatcccgtaatattcgcaatcacgggcagatggctgatttggcggactttcacgatggattcgacatccaaacggtagggatggcctttggtatggttcaatacgcccgactcgcccagaatcaggtggcggttgccgcgcgagacgacatattctgcggcattcaaccaatcttcggcagaatggtgcttgtctttacacagcaccaagggaatgttcaggtttccggcttcattcaatacggcaagatcggacatcagcccgccgcccaaatacaggatgtccgcccccgcattcaaagccgcttcgacatggcggacgttgcggacgcgcaccaatacgggtttccctgcatcatgcgccgatgcggtctgttccgccaaccgtctgcaccgtccccgcccttcatccgcacttgaagtgtcgtataagtttgccgaagtgaaaaacggatccagaaacactgcatccgcattgcgccatactgacggttctgcggcgatacggacggtttccccgccgccgaaagccacgcctttggcggcaacgcggctgtcttccgcccgattttcccgactgacggttttccatgtatccaaaatgcggacggctttctcgacctccggcagcgtctgcacctccctgacgctcaaaaccctatcgtcgccgattgcgccgatgacagtacgctcgtcgccgtgagaaatgtgttctcgcagacctctgctgcggataaaggcgacaacgccggcaatgtccgcttcggcggcacgcctgctcatgacaataatcatatttcctcctgacacaagaaacggcctacccaaaataggatttttgcaagccgtgttatactgtggcgtgttttacagattgttcgggctatggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaaacatcctgcgtacaaaaatgccgtctgaaacacccccgcgcttcagacggcagaccgtaaaacctacaaccccaattcctcccaaatcccatcaatcttagccgtaaccgcagggtcttttttgatgacgcgtccccattcgcggtcggtttctcccggccatttgttggtcgcatccaaacccattttgccgccgagtccgctgacggggctggcgaagtcgagataatcgatgggcgtgttttctaccaaaacagtgtcgcgcacggggtccatgcgcgtggtgaccgcccagatgacttctttccagtcgcgcacgttcacatcgtcatccaccacgatgatgaatttggtatacataaactggcgcaggaacgaccagcagcccatcatcacgcgcttggcgtgtccggcgtactgttttttcatgctcaccaccgccatgcggtaggagcagccttcgggcggcaggtagaaatcggtgatttcggggaactgcttttgcaaaagcggtacgaacacttcgttcaacgccacgcccaaaacggcgggttcatcgggcggtttgcccgtgtaggtcgaatggtaaatcgggttttcgcgcatggtgatgcgttcgaccgtaaacacagggaaataatcctgctcgttgtaatagccggtgtggtcgccgtacgggccttccaacgcggtttcgttcggatggatgacgccttccaacacgatttctgcgcgggcaggcacttgcaaatcgttgccgatacatttcaccagctccgtccgcgaaccgcgcagcagtccggcaaactggtattcgctcaaggtatcgggaacaggcgttaccgcgcccaaaatggtggcggggtcgcagccgagtacgacggcgacgggatacggcgtatcgggattgagtttgcggaactcctgataatccaacgcgccgccgcgatgcgacagccaacgcataatcagcttgtttttgccgatgagttgttggcggtaaatgccgagattttggcgttttttgtgcggcccgcgcgtgacggtcaagccccacgttaccagcggcgcaacgtcttccggccagcaatgctgaatcggaagttgatacaaatcaacgtcttcgccttcccacacgatttcctgacacggcgcgtttttcaccacgttcggcgccatgctccaaatgtctttcagcagcggcagtttggaaaacgcatctttgatgcctttgggcggttcgggttctttcaaatacgccagcgtctgcccaatttcacgcagcttggacacgctgtccgcgcccatgcccatcgccacacgttcgggcgtgccgaacaggtttgccaacacgggataaccgtagcgcgtaccgtcgggcttaatcgggttttcaaacagcaacgccggcccttcggcacgcagcacgcggtcggcgatttcggtcatttccaaatacggggaaatggggtgtgcgacgcgcttgagtttgccctgctgctcgagcatggcgatgaagtcgcgcaggtctttgtatttcatattcatcctttttgtccttttatcctgaacaatccgattcggataccgcccctatccttgcctgtgcctcggcatattctatgccgtgataaaagtcgcgtaccagcggatgttcgccgccttgatggagttgcaacaaaggacgttgaccatcgggttgggtaacgacattgcagtgcagaccgaaggtgtcggtttcataagggggcagctggttgcagatcatgccgaaataaacagcgttttcaaggttgtcgtaaaagcggctttgatagtcgttaaaactcttttcgctgacggatacccacacgccatattccagcgtttcctcatgcccgataatcggaatcggcagcaccgcgcggataaagcggtcggtttggtcgggatagcggatgatgcagaaatcagaatcgcattctgcttgataagcaatgcgttcttcttcactgagttgattatagggatcgggtgcggtaaagccgattgcgggcatttcttcgtggttttcgccgcaggaagtgcaagtgtacataaggtttcagactttcaaaacgagtttgcggtaaagccattcgccggcaaacagcatccccatcaatacataggcaatcacgccggtataaaccgcccaccaatcatatcgccccaaccgtgccaacaaagcggcaagcgtcccgttgattataaaaaatacgcaccaaacctgcgttacccggcgggtatagcgcacggctttttcaggcaggtcgggctgttgcagccgcgcaagtttttcaatcaccgtctgcccggcaaacaggctgccgccgaacaccgccaacatcatcagattgacgaggacgggataccaatacatcgaatcatgccgcccgaacaccaatactgcggcaaaaaacagtgtaataaacaaagccgcataacgctgttggggcagtttggcagtcagggcgcgcagcagccacaacccgcacatcgccgccgccagccaaacaaaccagcccgcctccctgccgtatatagtggattaacaaaaaccagtacagcgttgcctcgccttgccgtactgtctgcggcttcgtcgccttgtcctgatttttgttaatccactataccacaaagcgggataggcaatgcttaatacggtcagaaaaatatgtccgaaaaaaccgggtttcattttgaatccgcacaaatgttttcagacggcatccgataaaaacatgccgtctgaaaaataattagaaatacccgattagcccgcctgaatcttcaataccgcctgtaccacgtcgttgacggtgcggacattgcggaaatcttcggcctgcagcttgcggccggtttcgcgcttgatgcggtcaatcaggtcgatggcatcgatgctgtcgatttccaaatcttcgtaaagattggtatcaggcgtaatccgttccggttcgatttcaaacaactcggtcagggtatcgcgcaacaaccggtagatttcttgttcggtcatatgtttcatccttatgcttggcggcttttgacaaaggcggcgagtgttttgacattggcaaaatgttcgcgcaagttctcctgctcgccgtccaatcggaaaccgaaatgtttttgcaccgccaagcccaattccagcgcatcgacggaatccagtcccagccctccgtcgccgaacagcgcgtcttcgctgccgatgtcggcggcggttatatcctccaaagccaaactgtcgataatcagttgtttgatttggttttccaagtcgttcatatggttttccttgtaaaatagtcctgcagatattcattcagccgccgcgccgcaatcggcaacggtttctcggcgagccagtcttgggggaggatgtcgtctccgacggtaatttcataccgtatccttttcggggggatgcggtaccacggctgcccctttttaaaattgggcggattcattttgatacatacgggcgtaatcacttcggcataccgcagtcccaaagaaaccgcgccccggtgcatttttacccgtccgtcccaccccgtcctcgttccttcggggaacaccagcaggctctgcccgctgtcaaaaaccgcctttaccgtttccagcattgcttccgactcttcgttcggaatatagcccgcacctttaatctggctgctcattgccggattgtgctgcaaatcttttttcacgatacagttcatttcgggcacatggccgacaagcagcaccacatccagcaaagacggatggtttgccaaaatcaactgtcccgggcggttgagtttttcaacacccttgaacgatacctccaacacgcccgaccatttcagataagcaacgaacaaacgccaagatgttccgataatccggcgcgccgccaattggcgggcgacagaccctgaagtgccgttcaaagtataaggcaacaaaaccaatttcatcataatgccgccgacaccgaaaatcacaaatcctaaccaagtcgcaaaaaaacggcggcaataatccaatttatccattccgctgccacagccattcacgattgcgatatacccggcggcattctcgactgccgttcagcagaaagcgcacccattccaaaccgctccaatatgcctcgggcagcataccggcttcagacggcatatcgtccgaagcagacaaagtcaggctgtaacgcgtccctttggtcagaaccatcgccaaagcataagcaaacggcgcgcgagtcgccgatacggcatatccttccggcagcggatcgtccgccgccaaaaccaaaaccgacccgcatccctcttccaacagtgatgccgcttccgccaatgccgtttccacaccgtcggcacacacggccaatgccgtctgctcgctcatatcctgacgcaatatcgaccattgccccgccgttgcattgtgcaccgacaaaccgaacgaagtcggcgacacggtatgcgatttcaacagttccaaccacaaatcgaaactgcgtgccatttccccgtcgtgcgaggcataaactaccggactgccgggatgggcggaggcaatgtcccaagccgcgtcgcataccaaacgcgccgccttactcaaacggcggcgctgcatagcgggcaggaacggcaattccggcctgacatcgggcaaaccgtcggcaaaatccggacattccgcccattttgcccactgggccatatcgcgcattttgctgcccgaaacccgccaggcggcgatgtcgaagtggaaccggcaaataatcgacggcatagtttctttcaaaaatttacactgtgccgcattctaaccaaagcctatccccctgacaatgccgaaattcaaacgcatttctgccccctttctccgacaacgccgcccctcggaaaaccgccagaattagcctgaatttacatttatcattataatgcccgtatttgccagcctgccgccgcaatatatggacacactgccagaatgcccgattaccaacaccgcctccctgctgccgcacagcgggcgtatggttctgatagaccgcattacccgatacggcgatgattttgtcgaagcaggggcacaggtaagccccaatcacatccttttacttgacgacaaactgccctacacggcatttatcgaactgatggcacaggctgtcggcgcgtatgccggtatccaagcccgaaaaaacgcacggtcggtccggctcggcttcctgctcggcacgcgcaaacttgaaatcttcgcccaatccgtcccaatcggcacgcatctgctggcaacggcgcatatgtctattcaggatgccgggggtatgggcgtgtttgactgcgaactgcgttggacagacgcgccggaaacttcgtccgaaacactcccttcagacggcattttggcgcgcgcctcactcaacgtgtacagccccgaacaccctgccggaacaaccgatgccgtctgaacaggcacacacatacggagaacaacgatgaccgaaactgtcctgattaccggctccaacaggggcataggcaaagccgtcgcattcggtttggcggaagacggctttgatatcgctgtccactgccgcagtcgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggactgacgcgcgacaataccttccccgcgttttcagatgacgattgggatgtggtgctgcggactaatttggacggtttttacaatgtattgcatccgctggttatgccgatgatacgccgccgcaaagccggacggattgtgtgtatggcatcagtgtccggcctgacgggcaaccgcgggcaggtcaattacagcgcgtcaaaagcaggcattatcggcgcggcaaaagccttggcggtcgaactggcgaaacgcaaaatcaccgtcaactgtgtcgcgccgggtctcatcgataccgatattatcgatgagaacgtacctgtcgaagaaatcttaaaggctgtccccgcagcgcttatggggctgccggaagaagtggcgcacgcggtgcgtttcctgatggatgaaaaagcggcgtacatcacgcgccaggtgattgcggtgaacggaggtttgtgttgaataccagaagggtcgcagtaacaggcataggcggcattaccgccttcggccgggattggcaaagcatacaggcagcattcaaagccgaaaaaaacgccgtcaaatatatggattggcacgaacgtttccccgaattggaagcgcaactgggtgcgccgattgaaaattacgcgccgccgaaacattggacgcgcaagcagctcagaagtatggggcgcgtgtcgtacctgtgcgtcgatgcggcggagcaggcgctggcggatgccggtttgctcggggacgaaagcattaccgacggacggatgggcgttgcctgcggctcttccagcggcagcaccaaagacatcggcgatgtgggcgaattgttgctgaccggcacgtcgcgcaacttcagcgccaacacctatgtgcgtatgatgccgcacaccaccgccgccaatatcggcatctttttcgggctgaaagggcgcatcatcccgacatcgagcgcgtgttcgtccggcagccaaggcataggttatgcctacgaagccatcaaatacggtctgaccgatatgatgctggcgggcggaggcgaagaatttttcccgtccgaagtgtatgttttcgactcgctttatgccgccagccgccgcaacggcgaaccggaaaaaaccccgcgcccatacgacgcgaaccgcgacgggctggtcatcggcgaaggcgcggggattttcgtgctggaagaattggaacacgccaaacggcgcggtgcgataatttacgccgaactcgtcggctacggagccaacagcgatgcctaccatatttccacgccccgccccgacgcgcaaggcgcaatccttgcctttcagacggcattgcaacacgcaaaccttgcacccgaagacatcggctggattaatctgcacggcaccgggacgcaccacaacgacaatatggaaagccgcgccgttgcagcggttttcggcaacaatacgccctgcacgtccaccaagccgcaaaccggacacacgctgggcgcggcggacgcaatcgaagccgcgttcgcgtggggcattgccgaccggcaaagcaatcccgaaggaaaacttccgccccggctttgggacgggcagaacgaccccaacctgcccgccatcaacctgaccggcagcggcagccgctgggaaaccgaaaaacgcattaccgccagctcgtcgtttgccttcggaggaagcaactgcgtcttaatcatcggatgaaataagtttgtcaatcccaccgctatgctatacaatacgcgcctactcttgacgggtctgtagctcaggggttagagcaggggactcataatcccttggtcgtgggttcgaaccccaccggacccaccaattcccaagcccggacgtatgtttgggcttttttgccgccctgtgaaaccaaaatgctttgagaaaccttgataatgaaaaaagtcagcgtattgattgttgccaaaaacgaagcaaaccacattcaggaatgtattgaaagttgccgtttcgataaagaagttatcgttatcgacgactacagcaccgacaatactgccgaaattgccgagggtttgggcgcaaaagtcttcagacggcatttgaatggggatttcggagcgcaaaaaacatttgccatcgaacaggcaggcggagaatgggttttcctgattgatgcagacgaacgctgcacgccggaactatctgatgaaatctcaaaaattgtccaaaccggcgattatgccgcctattttgtcgaacgccgcaaccttttccccaaccatcccgccacacacggcgcgatgcgtcccgacagcgtatgccgtctgatgccgaaaaaagacagttcggtgcaaggcaaagtacacgaaaccgtacaaaccccctaccccaaacgccgtctgaagcattttatgtaccattacacgtacgacaactgggaacaatatttcaacaagttcaacaaatatacttccatttcagccgaaaaataccgagagcagggaaagcccgtgcgtttcgttagggacattatcctccgcccgatttgggggtttttcaaaatttatatcctgaacaaagggtttcttgatggaaaaatgggttggattatgtccgtcaaccacagctattacacgatgattaaatatgtcaaactatattatctgtacaaatccggcggaaaattttaaatggaaaaagaattcaggatattaaatatcgtatcggccaagatttggggtggaggcgaacaatatgtctatgatgtttcaaaagcattggggcttcggggctgcacaatgtttaccgccgtcaataaaaataatgaattgatgcacaggcgattttccgaagtttcttccgttttcacaacgcgccttcacacgctcaacgggctgttttcgctctacgcacttacccgctttatccggaaaaaccgcatttcccacctgatgatacacaccggcaaaattgccgccttatccatacttttgaaaaaactgaccggggtgcgcctgatatttgtcaaacataatgtcgtcgccaacaaaaccgatttttaccaccgcctgatacagaaaaacacagaccgctttatttgcgtttcccgtctggtttacgatgtgcaaaccgccgacaatccctttaaagaaaaataccggattgttcataacggtatcgataccggccgtttccctccctctcaagaaaaacccgacagccgtttttttaccgtcgcctacgccggcaggatcagtccagaaaaaggattggaaaacctgattgaagcctgtgtgatactgcatcggaaatatcctcaaatcaggctcaaattggcaggggacggacatccggattatatgtgccgcctgaagcgggacgtatctgcttcaggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggggcgcaaaaggaaattgtcgaacatcatcaatcggggattctgctggacaggctgacacctgaatctttggcggacgaaatcgaacgcctcgtcttgaaccctgaaacgaaaaacgcactggcaacggcagctcatcaatgcgtcgccgcccgttttaccatcaaccataccgccgacaaattattggatgcaatataaactgctttcagacggcatatgccgtctgaaagcctttgatgcaacaaaccactaaattatattcgttcattggaaagaaacaccccgaattcatccttcaaaataagaaaatcccaatatcccccgatattacgcagcctattggcaaagttttgcagcgtcttccccggcttgtgctgccgcgtcaagtgctttgttacaatgtatagtagactaacaaaaaccagtacagcgttgcctcgccttagctcaaagagaacgattctctaaggtgctcaagcaccaagtgaatcggttccgtactatctgtactgtctgcggcttcgtcgccttgtcctgatttttgttaatccactatactaccttcacatttcttaataaattttatgagtaaccatacttcttggtcgtccaaaatcggtttcgtccttgctgcggcaggttcggccatcggtttgggcgcgatttggaaatttccttatacggcaggcaccaacggcggcgcggtgtttttcctgctgtttttgatatttactatcttggtcgccctacccgttcagcttgccgaattttatatcgggcgcacgggcggtaaaaatgccgtcgattccttcagggttctgcgtccgggcacgcaatggctttgggtcgggcgtatgggcgttgccgcctgctttattttgctgtcgttttacagcgtggtcggcggatgggtattaaattatgtcgtccacagttttacgggggcggttcataccggcgcggactttgaagccttgttcggcgcgacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggcaatccgttcgctgacgctgccgggtgcaatggagggcgtgtctttcctgctcaaaccgaattggtcgtactttaaagccgatacgatgattacggctttaggccaggcgttttttgccctgagcatcggcgtttccgccatgattacctacgcttcatatttgggaaaagatcaggatatgttccgttccggccatacgattatgtggatgaacctcttggtttcgctgcttgccggcctggtgatttttccggcggtgttcgccttcggttttgaaccgagccaggggccgggattgatttttatcgtattgcccgcagtgtttatgaagatgccgttcggtacggttttgtttgcggtatttatgctgctggtcgttttcgccacgctgacttcggcattttcgatgttggaaacggtcattgcctcaaccatccgccaagacgagcgcaaacgcaaaaaacacacttggcttatcggcacggccattttcattatcggcatcccgtccgcgctgtctttcggcgtatggggcgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcatcaattctttggacatcctttaaaagccatccaaacagcaaaaatgccgtctgaaagcctttcagacggcatttttgcttcgggttcagcctatttcgttcaaagtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatagccttgcgcgatgccgttcaaggacaaacccatacccttttcggcaaaacggatttcacggtcgtcaaacgagactttgccgaagccgacccgtttcagggcttcgtccacgctgttttgaggaggcggcgtttccgcatcgggacgggcggcaaaataatcggcatacagtttccacaacgcctgcactgtcggatcgaacgcgccgtccgtcagcgcgtgaatatcgcggcacaggctcaacagttccaaaaaatccgccgacggcgaagtcagataaccgtccctgttcaggcggctgatcaggctgtcttcacggtaaaggctgaacaattttttccaaacgcgccacttccgccaaaaccttgttgaccaaatccgccgcacgcctgtcgtccacaccgaacagacggagctccgcaccggaacccagtgcgacacctttccagaaaaacacattttcattgcgtttttcatccccgttgcgtttttcatcatcggcggcaaaaggattcggcaggaaagaaaccgccgcgcccgccgccgcaacggcggcaaccgtcagaaaacgcctgcgcccgaaatgcctgcccataccgcctctaaaccgacactgccgccttgatatgcggatgagggtcgtaaccttccaactcgaaatcttcaaacttgaaggaaaacaaatctttgacttcaggattgattttcatcactggcaaggcgcgcggttcgcgttccaactgcaatgcggcctgctcgaaatggttgcggtacaaatgcgcgtcgccaaacgtatggacaaactcgcccgcctccaatccgcacacttgcgccatcatcatggtcaacaatgcgtagctggcaatattaaacggcacaccaaggaaaatatctgcactacgctggtaaagctggcaggacagtttgccgtcggcaacgtaaaactgaaacagcgcgtggcagggcggcaaggccatttcatcgaccaaagccggattccacgccgatacaatcaggcggcgcgagtcgggattcttcttgatttgttccagcacattggcgatttggtcgatatgcctgccgtcgggcgcgggccagttacgccactggtagccgtaaaccgggcctaagtcgccgttttcgtccgcccactcgtcccaaatggaaacattgttgtcctttaggtatttgatattggtatcgcctttgagaaaccaaagcagctcgtggataatcgaacgcagatgcagctttttggtcgtcagcagcggaaaacctttgcccaagtcaaaacgcatctgataaccgaatacggagcgcgtacccgtaccggtgcggtctgatttgtccgtaccgttgtcgaggacgtggcgcatcaagtccaaataggctttcatagcagtctttcatcaaattaaacggcgcatattgtaacatttccggataatgcccaaaacacggatacaggcaggcaggattgttggcaatttcagtccttttccacagtaaaacccggtgggaaaacaaaattaccttgattggaatcaaaaaatctagtttaattacttagaataaaatttcaataatatttttatttacgaaattaatttatgattattgattaattatcggcaacaaacatcaaacatcgaaaatatggaaaaaataatgtcaacaatttttgccaaatcgggcttggcatcagaaaaaaataggtttatattcccacctacaaatttgttttcccattagtacactatcaaccaaaaggagtatccgaatgactgacctgaacaccctgtttgccaacctcaaacaacgcaatcccaatcaggagccgttccatcaggcggttgaagaagtcttcatgagtctcgatccgtttttggcaaaaaatccgaaatacacccagcaaagcctgctggaacgcatcgtcgaacccgaacgcgtcgtgatgttccgcgtaacctggcaggacgataaagggcaagtccaagtcaaccggggctaccgcgtgcaaatgagttccgccatcggtccttacaaaggcggcctgcgcttccatccgaccgtcgatttgggcgtattgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcgggcgcgaaatcggctacctgttcggacaatacaaaaaaatccgcaacgagttttcttccgtcctgaccggcaaaggtttggaatggggcggcagcctcatccgtcccgaagcgaccggctacggctgcgtctatttcgcccaagcgatgctgcaaacccgcaacgatagttttgaaggcaaacgcgtcctgatttccggctccggcaatgtggcgcaatacgccgccgaaaaagccatccaactgggtgcgaaagtactgaccgtttccgactccaacggcttcgtcctcttccccgacagcggtatgaccgaagcgcaactcgccgccttgatcgaattgaaagaagtccgccgcgaacgcgttgccacctacgccaaagagcaaggtctgcaatactttgaaaaacaaaaaccgtggggcgtcgccgccgaaatcgccctgccctgcgcgacccagaacgaattggacgaagaagccgccaaaaccctgttggcaaacggctgctacgtcgttgccgaaggtgcgaatatgccgtcgactttgggcgcggtcgagcaatttatcaaagccggcatcctctacgccccgggaaaagcctccaatgccggcggcgtggcaacttcaggtttggaaatgagccaaaacgccatccgcctgtcttggactcgtgaagaagtcgaccaacgcctgttcggcatcatgcaaagcatccacgaatcctgtctgaaatacggcaaagtcggcgacacagtaaactacgtcaatggtgcgaacattgccggtttcgtcaaagttgccgatgcgatgctggcgcaaggcttctaagcaaacgccgccgctccgcaaacaaaatgccgtccgaaccgcaaatgctgttcagacggcatttccttatccgcccgttcaaatcgggtgagactaccgatacatctgaatatgctatgccgtctgaacggcattcacaccgcccaatcctgcacgcgcttcaaatcattttgcgccaaagtatctgcgtggcggttacggctctgatattccctgtctttcaagatgctgctcgccacataattcaaatgtgcctttgccgcctccgaagcctcgcccggccggcggtttgatattgcctcatacaatacacggtgctgcgccatcagcttcggacgcggatcttcttcctgattcagataaataaggctgctgcgcgtctgccggtacagcattttcaacaaaccgcccgacaaatggctgaacaacaaattgtgcgccgcatcggcaatcgtctgatgaaagctgacatcagcttcgctctgatgttccaaattgccgctttcgcacgcctcctcaaacttttcaagccaaaacccaatccgcttcaaatcggcatccgtgcggcgttctgccgccaatgccgccatacagccctcgatgtggcaactgaaatcaaaaacatcctgttcccaattggaatgcttgcccaaaagctcctgccaactttgcaaaaaatcctgctgcggcttgaccgaaacataataaccgtctccctgcctcgcttccaaaacctgacgggcgaccaaaacattcaatgccgacctgaccgacgggcgcgaaacgccgaactcttccgccaaaacgcgttcgggcggaatcttgcccccttccgcgtaaaccccttccgcaatgcgctcctccaataccgacaatacctgatcgctgattttctgaggccttaccagtttcatcactcctcctttataaagattccctgcagaacccttccgaaatatagtggattaacaaaaatcaggacaaggtgacgaagccgcagacagtacaaatagtacagaaccgattcacttggtgcttcagcaccttagagaatcgttctctttgagctaaggcgaggcaacgccgtactggtttttgttcatccactatacatcaaacatcaaattggactgaccaatcagggcggattctaatgacacgccgttcccgccgtcaacggcatttacctcgcaccgcccccgaaacacaagaaaaaactacaccaaactacaatttttgttcatgcaaatatttgttttgacaggatttaaacaaaagctccgattcaaatctgccgaaccgcccaaaaatatattgacctaaatattaaagtttcgtaaagtaatgcaacgttgctttaattggtttgaccactattgccgacgattagaaaaatattttcggagatgttcaattatggaaacttgggttcaaaactacacggcaatcggcggcagcctgtatctgactgccgccgccgcactcttacccatcgtctttttctttgccgcgctgaccgtcctgaagctgaaaggctatcaggcggggctttatacgctgctgattgcgcttgccgttgccgtattcggcttcgggatgccgacgggtatggcggtttcttccctgccgccgcagccgcattgacccaacgcccctacgccacactgtatttgaccgcgcattacaaaatcggcaaatccacccgcatcggtttggactttgaaaacgtgttcaacaaacgctaccgccctatgcccgacattcacgtttacggcacgccgcgcagcctgaccgcaaccgtcaaacatatagtggattaacaaaaatcaggacaaggcgacgaagccgcagacagtacaaatagtacggaaccgattcacttggtgcttcagcaccttagagaatcgttctctttgagctaaggcgagccaacgctgtactggtttttgttaatccactataaagaaagaaatgccgtctgaaaccttatcgtttcagacggccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatccggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccggcattttattgcccgaccggttatttgtcggtttgggtatcccgtttcaatccgccgccgagtgccttgtacaaatcggcaaggttttcggcgcgggtcagttgtgccgacaaagccgcaccctccgccgcatagctgctgcgttccgcatcgagcaagtcgagcgcgccggatacgccgtgcttgtaacgcaggccgaccaagcgcaacgcttctttagaggcgcggctttgtttgcttaaagcgtcataggctttatccagctgctcgcgcgccgccaatgcgtttgccacgtcttgaaatgcggattggacggcggattcataggcaacgatttgtacctgttggcgcagcttggctacatcaaggttcgccttgttcgtaccccaggtaaaaatcggcagggtaatagacggcgcgaacgaccaaacgcccgtgccgcttttgaacaacccacccaattcggcagaacccgtaccgacggttccggtcaggcggatggatgggaaaaaggcggcgcgtgccgcaccgatattggcgtttgcctgtttgagcgcgtgttcggcagcacggatatcgggacggtcgagcaatacttcggaactcaaaccggccggcagtttttcaacaaaaaactgcttgtccagcggcaaaccggcaggcaggtcttcgggtatcggttggttaatcaaggttgccaaggcattgcgcgcctgttcgcggctgcgcgcggcatgggcataatcggctttggcagattcgatcagggcttcctgctgacgtagggcgacggcggaaatcacgcctgccttgtaacgtaattcggacagcttgtaggtttcctcgcgcgttttcaaaacacgttgcgccaaagacatcgcttcttcggcgtaacgttcgttgaaataggctttggcaacggtggcaatcaggctcaaatgtgccgcatcgcggttggcggtgctggcgaaatagccttgcagtgccgcctcgctgctgctgcgtacacgcccgaacagatcgagttcgtaagatgccgcacccagtccgactttgtagctgctgcttacattgccgccgctcaagctgccttggcgcgagtcgttcgcattggcggcaagcgtgggcaggaggttgttgcgctcaatcatgtattgtttgcggtagatttcgctgttcaatacggcggtacgcaaactggtattgcgctcgagtgcgatgtcgatcagcttttgcaggcgcgggtcggcaaaatagtcatgccaacctaaatcgacggcgcggatgccgctgtcggcggtatcgtttttgaacgtttcggcaacttcgactttgggctgctcgtattggggaatcatggtgcaggcagacaatgcaaaggctgctgcaacagaagtcaaggtggttttcaatgtagtatccataaaaaagtcctgatgccgtctgaaaacccgtgggcgttcagacggcatggttgcttaatgttggctgtcgtccgaaccggtgatgcccgcttcggcggcgtgttttactgccatttcgtgttcgtgcgcggtttctttgaagaatttgcgcaccaccacatagaaaagcggaacaaggaacacggacaagagcgtgccgatgagcatcccccagaatacggttgtaccgatggcgcgctggctggcagaacttgcaccgccggcaatatacaggggaaccacgcccaaaataaaggcgaacgaggtcatgataatcggacggaaacgcaggcgggcggcttccaaagcggcttcaaccgcgcttttcccttgcgcttgaaggtctttggcaaattcgataatcaaaatcgcatttttcgcactcaaacccatcacggtaacgaaaccgacttgaaagtagatgtcgttggcgaacgagggaacgctgcccaacagtccttcaaacaggttgcgcccggttacgcccgcagccgcaccgatcaaacccaacggaatcacaaggatgaccgccagcggaatcgaccagctttcataaagcgcggcaagtaccaaaaatacggctgcaaccgccaaaccgtacaaaatcagggtttgcgagccgccttttgcctcttcgcgcgactgtccgccccactccaggctgtaaccgccgcccaattcgtcaaccattttttgaaccgccgccatagcctgcccggtggaaacgccggttgcaggcgaagcggacagcttcatcgaaggataaccgttgaagcgtacgctctgttccgtaccgttttcccaagaaacagtagcaatggtggaaagcggtacggcgacgccggatttgttcggcacggtcaggttcaaaatatcggcaggctgcatacgggcatcctcgtcggcctgcaccatcacgcgttgcagacggccttggttcgggaagtcgctgacataagacgaactcagcgcgcttgccaatgcggtgcggatgtcggcaaacgaaatgccttgcgccgccgccgcggcacggttgatgtcgattttcaactgcggcgagtcttccaaaccgccagcacggacggtgctggggtcaaacaaaccgctggcacgcattttctgaatcaactcgttgcgcttcgccagcaatgcggtatggccggtattgttgcggtcttgcaggttgatgctcagacccgaaccgttgcccaactccagaatcggaggcgggacgacggcgatgccaaaaccgtctttaagcgtccccatcatcatacccgtcagcttgccggcaatcgcaacggcatcgctgccgggcgcggtacgctcgttccaatctttcaatatggcaaaacccatcgccatattctgaccgctgcccgaaaagctgaagccggaaacggtaatgatgttttctatttcaggaatgcttttcgccagttgggtaacttgcgccaaagtcgcattggtgcgctcttgggtcgctcctgcaggcagttgcacgctgaccatgacgaagccttggtcttcggtcggcaggaatgaagtcggcaggcgcataaacaggaacacgcccacaaccgccaagccgatatagacaaccatcatgcggaaagtcttacgcagcactttggcaacccggccttcgtaaccgtgcgtccaactgttgaatttcttgttaaaccagccgaagaaaccttttttctcttcgtgatgccctttcgggattgtcttcaacattgtggcacacaaagcaggggtaagggtcagcgcaaggaaggcggagaatgcgattgatgacgccatcgtcagggcaaactgtttgtaaatattgcccgtcgccccgctgaacatcgccaacggtacgaacacggaaatcagaacggcggtaataccgatgaccgcgcccgaaatctgacccatcgcttttttggtcgcttctttgggcggcaagccttcacccgccataatgcgctcgacgttttcaaccaccacaatcgcgtcatcgaccacgatgccgatgaccaaaaccatcgcaaacatggtcagtacgttaatcgacatgcccatataagagatgaaggcgaaaccgcccaacagcgaaatcggtacgacgatggtcggaatcagcgtataacggatgttttgcaggaagagatacattacgacaaacaccagcaccatcgcttcgattaaagtgtgaatcactttttcaatcgaaatttcgacgaatttggaagtatcgtaaggggttttccagctcataccctgaggaaagtatttttccaacgtcgccatgcgttctttaaccgcctttgccgtcgccatcgcattgccgctgttggacagcatcaccgccataccggtggtatttacaccgttcagacgggttgaggaagaatagtcttccatacccagtccgacccttgccacatccttcaggtaaacattagaaccgtcggtattggcgcggaggatgacgttgccgaattcttctgccgtacccaactgcccttgcgccgttacggtagccgtaaccgtctgtccgcgaacggcgggaagcgaaccgatagaacccgctgaaatctggacgttctgggcggacagcgcgctgccaacatcggcaaacgacaaattgtagttttgcagtttcttaggatcaacccaaatccgcatcgcgcgttgcgcgccgaacaggcgtacctgccccacgccttcgatacgctgcaactcgggaacgatattacgctgcgcgtagtcgttcatctcttcggttgactgcacatccgacgaaagcatcacaatcatcaggaaattggaacgcgccttggatacggttacgccgtattgctggacagttgccggcagcgtgctcaatacttcggaaagcttgttctgcacttccacctgcgccagattctcgtcggtatcgggcgtaaaggtcaggctcacgctgccgctgccgctcgaatcggcggaagtggacatataatccaaaccttccacgccgttcatattccgctcgatcacggaaagcacgctgtcttccattacctgcgcggacgcgcccggataagtggccctcagggtgatggtcggggcggcgacggacggatattgcgaaaccggcaggcttttgatgccgaaaatacccgccgcaataatgaaaatcgaaataacccacgcaaaaatggggcggtcgataaaaaatttagccatcgatgccttccttatttcgcttcagaagcaggtttggcttcagatgccgtctgaacgccggattgaggcgcggcggcttggttttcagacgacgcccattctttgggcgttacctttttcgcacccgttataccggcgatactgatgccttccacaaccaccttgtccccgtccttcagacccgacgtaacaatccaattcgtaccctgctgttgcgcaaccgttacctcgcggggttccataccgccttgggcattcacaatcatcacggtatctttcgcaccgcgcgttaccgcctgctgcggcacaacaaatgcgttatccaccgccacttggtccatcagcacgcgcacatacagaccgggcatcaagatattctgatcgttcggtacggcggcgcgcagggtaatctgaccggtcgattcgttgacggccggatcggcaaacagcaggcggcctttttcagggtaaactgtgccgtcgtcaaatttgatgccgaccgcaatcacaccatccgccgccagcagtttgccttcggctatctgacggcgcaatttcatcacttcggatgcagactgggtaacgttcacatacatcggattggtttggcggatggtcgccagtacggtcgcatcgccagcgttcagcaacgtaccttcggaaactttggactgaccgataaagccggaaatcggcgcggtaatgcgcgaacggttcaggctgatgccggcggatttgattgccgcctgcgccgctttaacgcctgcctcggcagaacgtttcgccgttaccgcagcatcgtattcctgccggctgacggcttcggcggcaaccaaaggcttgtatcgcgccaaatccgcatccgctttggcaagcgttgcctgagccgttgccagttgcgcgcgcgcgctttccagacctgcttcataagtggaactgtcgatctgatacagcggctgtccggcacggacataactgccttcttggaacaggcgtttttggatgatgccgccgacttgggcgcggacatcggcggtacgcagcgattccaaacgccccggcaactcgacggtcaatgcgacggtttgcggatggacggttacgacaccgacgacgggcgcaggggcttcccgaccagcaggctgcccgccctgcgccgcgtctccgcctttaccgcaagacgacagtaccaatgcaacggcggcagccaacgcggccgcacgcatcgccttaaaagcataaaaagccattatttatcctatctgtctggtttgatgtaaagggttttgccaatcaacaggcattcttatagtggattaacaaaaaccagtacggcgttgcctcgccttagctcaaagagaacgattctctaaggtgctgaagcaccaagtgaatcggttccgtactatttgtactgtctgcggctcgccgccttgtcctgatttttgttaatccactatatttcaggatataaaaaccgcctgcttcgccaacccgatgttcaaacgggttgcgaagcaggtttcatgggttttcaaagttgagatgtagtctcaatttcatgggtttcattatacatacacgattgcatggttacaaagtcttttttataatccgccctcatcaaaccgacccgaaacgaaaccgccattatgagaaaaaccaaaaccgaagccttaaaaaccaaagaacacctgatgcttgccgccttggaaaccttttaccgcaaagggattgcgcgcacctcgctcaacgaaatcgcccaagccgccggcgtaacgcgcggcgcgctctattggcatttcaaaaataaggaagacttgttcgacgcgctgttccaacgtatctgcgacgacatcgaaaactgcatcgcgcaagatgccgaagatgccgaaggagggtcttgggcggtattccgccacacgctgctgcactttttcgagcggctgcaaagcaacgacatctactacaaattccacaacatcctgtttttaaaatgcgaacacacggagcaaaacgccgccgttatcgccattgcccgcaagcatcaggcaatctggcgcgagaaaattaccgccgttttgaccgaagcggtggaaaatcaggatttggctgacgatttggacaaggaaacggcagttatcttcatcaaatcaaccttggacgggctgatttggcggtggttctcttcctgcgaacgtttcgatttgggcaaaaccgccccgcgcatcatcgggataatgatggacaacttggaaaaccatcccgacctgcgccggaaataatcaagccttggtagcaatgccgtctgaaacgaacaaaccctttcagacggcatcaaaatgacacaaagccttcttctaaaaatacatattgagacctttgcaataacataggttactaaaattttatgctcaatcttattttcaaaatgcaaaacttttctgatttttcctactttttgctcaatattaggaaggttttaggcaattgaaaattttttggcgcatttttatgcgtcaaatttcgttaacagactatttttgcaaaggtctcatattcactaaattgcatttttaatttcttctatcattgcatggacattctcttggtcaaaatgtccgttttcttctgaataaacttctaacaaataatgttcaatgaacgttttatctgtcgtcagcgatacatctctggcaatgtcttcatacgactcaaaatcatcttcatgccagggattatatttgtccatatttttttgaatttcatttttcatatcatttaccttccaatatttatttacaattaataacaataccattcaaaatgtaaactgcatttttctccagcatttttgcaaataaaaactgaaaatcccgccatttccgcgaaaacgggaaaccgttttttgagttccagtcattcctgataaggctttaacgtcaagttttcggattaccgcctttatgagaataacgatgtgggcattttctgttttaatctattgcggttatatacatatgcgattattttagtttgcttacaaaacacttcatgttacattcaaaaatttaatgcactcaatatatttttttaaggagaagcagatgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaaacacgataaacaaaatgccgtctgaaatgcttaaacgctttcagacggcatttgcctttctatcccgtcaggcttctccggcctcttcctttttttccgctgcggcaagcgtgtcggcaagcagacggacgaggttttcaaacaggggctgttcgagcgggttttggcttgcgttgccgaacacgagggcgacttcggtatagtctttctgccctttgctgactttgctgccgtggtaggcggtttgggcttttttcagggcggcttcccaatcttgtttttgggcaaacgcttcggcggtggcaagcgaggttttggcaaaaaacggcagcgggcggttttgcccgatattgaaaaacgccatccattccgacaatagctgcaatgccctgtcttgcgcgatttccgccaatatttcggtttctccggattggacgataaaggtttgccgcatttcggcttcagacggcataacggcgcaaaatatcaggtgttccagcagaaaagcgatacgttgcggcgcgttgggtttgccgtaggcgtaaaacacttgtccgcagcggtacagattgcccaagctgcctttcaggatttgcccgtccgacggtatggcatatgaaagcggtggcagtttggggctgtttaaaaccgccgtgtcgatttgtttggcagcagtttggaagtcctgctgccaaagtctgcccaactctcccgacggcaggaggctttccgccccgatgcgggcggcggtttgggcaaaatcccgtccttcgcaccgtgcttcgatgtagatttcggcgatttgatcggcgtgttgcggctcgaagggttcggcaggctcccaggcttcgccgatatggggttcgctccacgcaagctgctgctgaagccatactttgacagggttgcgccagaaacggataaattcgtcctgtccgatttcggcaacaggttcggcgttttctacgggttgatcgaaaaagggttgcggcggttcgggcgtttgtccgagcgcggcggcgtagtcggtacgcgtgccgaatatgccgtctgaacgtccgccttcttgaaaatatcggcgcgagaaggcttgcagcggatgctgttctatcaggttttgtgcaagttggcggctaccgatgcccgccatagcggcaacggtatcgatgagttcgcccaacagggaagacggggcaagctcttcgtctttgcggatgtcgcgcccgatgtaggacaggtagaggatttcacgcgcgctgatgagggcttcgaggaacaggtagcggtcgtcatcgcggcgggcgcggtctcctttggcgggatgtttggcaatcaggtcgaatacggcggctttggtattacggggaaaatctccgtcgttcaaacccaacaggcagatgactttgaacggcaggctccgcatcggcaccatactgcaaaaggtgatgccgccgcgtaaaaagcctgcctcgctttcgctgtcgagaaagcgtcggatatggcggatgacggtgtgcggcggcaactgtccggaaaattgcgccaattcggtttccgcctgccatttgacccattcgttttcaaggttttggactgacttttggtcatcggcttcagcttggaacaatgtttcaagcaaatcccggcaacgcgccacccattcgccgaccgttgcgggctgccgccatatccgtacaatatccgtcagggtttcgaggaaggcggcaaaacgtccgaacatggcggtttgattcacgtcggcataccacgcgctgacatcctgccacatcggattgccgcctttgggcagcatccagcccaatatcatgcgttctaccgcctgcttccaggtgaacagctgatccgtgccgccgcgcatttctccgtccaaaccccagtggacgttcaaatcggcaaccatgtcgtgcaaaagcggtaaatcgtcctcagtcagtccgaaacggcgcaacacgggcgcggtttctaaaagcacaagcactttatcgacttcaaatcggctttccaacaagtcgaacaggcatgacaaagcatgaaacagcggttggcggcggctgattttcacgtctgacacggaatacggcaatgcctgcgcaccgggctgcgcctgtccgaacacggcttcgataaaaggcgtataggattcgatattcggggttaatacggcgatatcgtgcggctgccaatcgggatgttcatgcagaattttcaacagcttgtctttgagtatctgcaattcgcgcaaagggctgtgtgcggagacgatgcgtatcgagccgtcgcccgtgttgacgcttcccgccatttcagacggcattttcaggttttgaatatcggtttgcagggcgtgtaaaagcgtatcgcgcccgccttcctcaaataccggcgtttcgccttctatttccatttcgttcaaaaagtcgaaaaagtcccgcccctgcttgcccaatgaggcgagcagcggatgccctgcctgagttaaatcgggatcgccgccacctttgaggatttgcgccgcttcgatgacgttgccccagtacatcccgctcggattgagtgcgaacacgaacacgtcgcaatgttcggacagcttgtgcaaaagttgcaaatacatcggcgccatcgtggaaatgccgaacacgaaataacgctcgggcagcttatcactgctcaaagattccaacagcttttcccacaacgcgacacggtgcggcgcgctctgcctgccgtcgtcgaggtaacgccacagtttggactgccagatttcgtcgtcgcccaaaccgagccgcctgccctgctgccaagcgtctatccactgaggacggtacacgaggtattggtcgaatatgtccgcaagctgtcccgcaagctggtaatctgccgattcgccgctgcccagatagtcttgcagcacattcctcacatcttcaaattctgccgtattccgaaatgcctcgctgcggaacaaatccagcagccgccagcgcatgacttcgggcgcaaacgggctgagttccggaataccgggaatcagttttttcatcagcttccacgtcaggccggcgggcaggctgaacgacaaattcgccgccacgcccaaatcgcgggcgaggcaggtattgaggtagcggcgcatcccctgactctgcacaataatctgttcgggctgtaaagccgatttcagcggtttgactttttgaatgcgggcaaacaatgccgccagcgtttcaagacggttggattgatacagataaaacatgatttcaaacagaagctgtggtcaagtattcgggattatatagcctttcccccgtccgccttcaaacaaaatgccgtctgaacctttcagacggcatttggtcatttaaaccatctcctcaaaacaggaatccgcgacaacagcagcgtatccaacagccaaatcacggcaatggcaagcagtgaggtcgggaagagcagtgcgattgccaatagcggcaatgccatcatccaccaaaccggcagcttgactttctgcgccggcggaacgatgcccaccgctccggtcggacggcgtttccaccacatcacgcagccgctgataccgataaaaatgacggcaaggcagaacaagacgttcgccaacacgctccaccagcccagagtccccatatgcagcgcaatgcttgccgccataaatttgccgaacgggttgtaatcgtcaaaacggatgtcggcaaggattttgccgctgtactggtcgatatgtaccgtgcggtcggcaaacgggctgatcatgtcgtaactcatagaatcctgcgacaaagtccatacgccgtcctcgcctttgggcaaattcaactgataacgccctttgaaaccgatttcccgcgcaaagcggtcgacggtttccaatgtcatcggctcgtcagggttaatgccgtctttgcccacagtcgtccctgaaacaggcataggcgtaagctccaaaacccacggcacttccttaaccttgccgtcattcaatacctcgccgtgggtcggcacgactgaaacggggttcggttcgacaccccatttaccggcagggaactgactccaagcctgtacgaacttgccgccccaaatacccgcccaagcaatacccgacaggcagaacaacagcaaaatcaacgacacccaagttccaaacgtgccgtgcagattccgccaccaagaacgcgccctgccttttgacggcagcagcatcgccttgatgccgcgccgtttcacccaccaaaggtacaagccgctgacaaccataataatggtcagtgaagctgccgtttccaaaagataatcgcctgccgcaccgagcatcatatcgctgtggatttcatccatcgtgtaataccaaccctgattgcgcggcatggtactgaccacttttgccgtataaggatcgaccgcgaccatcgttgctttgccctcattgttgacacggaacacggcaaccatatcatcggcacgcggcgcaatatactgaacgacggacgaagtttccggattaacggcactgcgtgccgcttccgcctgaacagacagaggttgtaccgttgcctgcggcacaacatgaatccgctcgccctccttaccggtaatattggcaaacagcagcatacccaaacccgtaacggcaagcagggtaagaaaaggcataaccagcagaccggcataaaaatgccaccgccaaacggtcagataacgccggttgctctgattgtcggcttcagttttgatttgtgtatccattaatcgtccttttgaaaatagggctatcgtgatgatgcgcgattataaacaataaagactaattctttatgactaaagtcaaaattcattacaacaaataggcagtctgcgtttaaaaccggatgcccgttaaaacaaaaaatccagattcaatactgaatctggattttcataaccgataatatcggaaactcagtcaagttagaatttgccgcctgactggttgaccatatagtcaaccgcagctttaacctcatcatcgctcaaatcgccgcgaccgccttttgcgggcatcgtattgaaaccttcgatcgcgtgtttgtgcaacgtgtccttgccttttttgatgcggtcggcccaatcggctttgatgcctacatggggaatacccggaatcgcattgccatggcaggcggcacaaacggtttcataaacctatttgccgtccgctttggcagcaggtgcagctttttcctcggctttaggttctgctgcggcaggtttggcttcggacacggcttgtgctgcttctgcaggagcagaggctgcgggttctgccgccggtgcgggagtcggtgcaggctcggcttttttcaccggagctttaccgtctttatcggaaagaccccatacataagcagtcataatatgcagtttgtctttatccaagaaatgtccccaagcgggcatttggctgctgcgaccgttggtaatggtttcgataatggatttttgcgtaccgccccacaaccacacgtcatcagtcaggttcggacccaaaccttggataccttgtcccttatcgccgtggcaagtgaaacagttggcaggcggaccgctgaacaaggcttgtccgcgcgcggcacgttcctcatcatactgaccttcgggttttgaaagggacatcacataatgggcaacgtctttcacgccttcttcgcccaaagcaggaccccaggcaggcatagtcgcaacacggcctttttcgatggtctcgtggattttatcgggatcaccgccccacaaccaatcgctatcggtcagattcggaaaacctttagagcctttagcatcagagccgtggcactggatacaataagtgttaaacaggttttgggcgatttgcttggcttgagggtcttttgccactttttcaatcggcatatccgcaaacttggcatacagtttgccgtattgctcatcggcttttttgacctctttttcatattggttatggctggtccatttcagcagacctttgtagtcgccgacacccggatacataaccaaataaccgataccgaacagccacgtcaaaacacacagccaaaaccaccagcggggcagcggattgtcgtattcggcaatgccgtcccactcatgacccgtagtttgtacttcttcgcccttcttcggacgtttgacaacattttgagacagcagcagccaagccaaagcgataaagctcagtaagacaataactgcaatatatatattccagaaattactggtaaattgggatgttgtgttcattgttttgctccgttatcacaatattaacggttttcgcttttcttatcttgcgcatcttggttttcatcaaaaatgctgtttgcggcattatcgtagtttttcttattccgcctgttgaagacgatatagagtaccaacaggaaacagataaagatccataccgtgaagagagcacgaataccgttaatatccatgatgttaccttacgtttttcaaagccagacccaatccttgcagataggcgactacagcatccagctcggatttgtttgccaaagcctcaggtgctttcgcaatttcctcatcactgtaaggagtacctactttacgcaaagccttcatgttggcaacggttgcatcgacatcgactttattgcgtgcaagccacgggaatgccggcatattggactcaggcacgacatcacggggattcagcaggtggatacggtgccattcgtcggaatagcgaccgcccacacgtgccaaatcaggaccggtacgtttggaaccccattggaacggatggtcgtaaaccgactctccggcaacagagtaatgaccgtaacgctcggtttccgcacggaacggacgaatcatttgcgagtggcagttgtaacagccctcacggatgtaaatatcgcgtccggcaacctgcagggcattgtaaggcttcacgcccggcgccggctgtgttgccgccttggtaaaggccaagggcacaacttcaatcaacagaccgacactgactacaagcagcgtgaacacaatcagaacgccgattttttcttcagccaattgttgtaatttcattttggtagcctatctttcttagtattttagtggtgctgtgtttgggaaaccgcagggatttcggcatcgactgctttaccaccgatggctgtgcggtacacgttgtacgccataatgcacataccactcagatacaataaaccacctgcaaaacggatcacgtagtaaggcatggtgcgttttacggattcgacaaacgagtaggtcagcgtaccgtcatcgttcaaagaactccacatcaaaccctgcatcacaccggcaatccacatggcagcgatatacagaaccacgccgatggtcgcaatccaaaaatgtgcttctaccagcttggtgctgtgcatctgttctttgccgaacagacggggaatcatgtaatagacggaaccgatggttacaaagcctacccagcccaacgcacccgcatgaacgtgcgcgacggtccagtccgtatagtggctcaatgcattgaccgttttaatcgacatcatcgggccttcaaaggtagacataccgtagaaggacaaggatacaatcaggaatttaagaatcgggtctgtacgcagtttgtcccacgcgccggacaaggtcatgatgccgttaatcataccgccccaagagggtgcgaacagaatcaaagacagaaccatacccaaagattgcgtccagtcaggcagcgcagtgtagtgaagatggtgcggacccgcccacatataggtaaaaatcaacgcccagaagtgaacgacggacaggcggtaggagtaaacggggcgggctgcttgtttgggtacgaaatagtacatcatacccaagaagccggcagtcaggaagaagcccacggcattatgcccgtaccaccattgaaccatagcatcaatcgcaccggaatagacggggtatgacttcatcaaaccggccgggatgctgatattgttgacgatgtgtaaaagtgcgaccgccaaaataaagccgccgtagaaccagttggcaacgtaaatatgtttaatcttacgtttggcaatcgtaccgaagaatacgatggcgtaagccacccaaaccaaagtaatcagaatatcgatcggccattccagttcggcatattccttaccttgggtccaacccatagggaagctgacgacggcggcaacgattaccgcctgccagccccaaaaggtaaatgccggcagccaaccgccgaaaagacgggtattacaagtacgttggacaacgtagtatgatgtgccgatcaggccgcaaccgccaaatgcgaaaataaccgcattggtgtgcagcggacgcaggcggccgaagtggaaccaaggtccgatattagacaagtcgagggcaggagcaaaaagctgggcggcgacgataacgccgaccaacatacccacaatcccccaaactacagtcatgatggcgaactggcgcaccactttgtagttgtaagtttgtgtgtccatgagagtctccatgaatttatgggaataaagatttttatcctgccgcttccgcagcctgtttaaggtgcaatccgggcaagcgtaattttttctaaatttaacatatctgccttattacgccaagcggaattacattcgcaccgccgacgagccctttgcttaatctgttttttattacatataaatcatattgttataataaattacaacccgaccgccattgcttttgtttccaattttccctttttgtggcactttattgatgtaggttaagctgcattttaaaggtatttaatccatcccgtttaacgatatatttgatagttatgattcattataaaataaccccgtcccctctcgaccacgagtggcacatcctgctgacattcacacaagatgatgatcttcctatagaaataagcctgccaaactgggttccgggcagctatctgattcgggatttttcccgccacatcacttctatccatgcatcctgtaacggcacgtccatgccgctcgaacaaattgccaaaaaccgctggcatgccgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacgggtattccgtccgaatggcgtattgccacaacgctgccggaaacagggaggtttgtctttcaggcggcatcttatgccgaattgattgaccgacctgtcgagatgggcttgattgaatttttagattttgaggcggcaggcattccgcacacaattgccttaagcggcatatatcccgatttcgaccgcaacaggctggtttcggatatcaaaaaaatctgcgaaacagaactggcggtgttttcctcccctgccccgtttcaaaaatatttgttcctgctccacgtcggcgaccatatttacggcggtttggaacacaccgacagcaccgccctgctcgccgaccgccacagccttccgccgtacggtatgaccgatgccgacgatacctacaccacattgctcggacttttctcccacgaatattttcacgcgtggaacgtcaaatccatcaaacctgccgcgttcgtcccttatgacctcgacaaagaaaactataccgaacaactatgggcattcgaaggtattacatcctattacgacgatttgtttttggcacgcagccgcaccatctcgcccgaatcttatttaaacctgctggcacaaggcattacgcgcgtacaacaaacccgcggccgtttgaggcagaccttggcggaatcgagttttaccgcgtggaacaaattttacaaaccggatgaaaacagccccaacgccatcgtcagctactaccagaaaggcgcgcttgccgcattgtgccttgatctgataatacgcaaccgaagcaacggcagacattctctcgatacgttaatggacaaactctatcgggagtggagggacacacactcgggtattccggaaaaacactggcaaatccgctgtcaggaaattaccggcttggatttggaagattttttccaaaaagcgttatacagtaccgaagatttgccgcttgccgaatgcctggcaaccgcaggcgtgggactgaccttcctgccgcttccccgacaacacggcggcggatacgcagaacacatctgccccgtcccgtcggcaggcgattttggcgcacgtttcaaacaaaacaccgaccacatcgtcctgacccatgtcttcaacggcggcagcgcggaatctgcggcactgtgcccgcaagacaaaatcattgctttagacggttatgcctgcaccgactttaccgcacaatgggcccgataccacgtcaatgcaaaaatcaatatccacttcttccgtgccggcatattgcgtcaaaccgtcttgacggttcaggcagcggcagcggatactgccatcctacatatcacagaccggaacctgttggacaactggttgttcggttaaactttcagacggcattgcacacaaaatgccgtctgaaaaacaaccgcaaagtaaaggaaacaaaatggccattctgaaacttgacgaacacctctatatttctccgcaactgaccaaagccgatgcggaacaaatcgcgcaactgggcatcaaaaccgtcatctgcaaccgccccgaccgcgaagaagaatcgcaacccgacttcgcccaaatcaaacagtggctggaacaagcaggcgttactggattccatcaccaacccgttaccgcacgcgacatccaaaaacacgatgtcgaaaccttccgccaactcatcggacaagccgaatatcccgtccttgcctattgccggaccggtacgcgctgctccctcctgtggggcttccgccgggcggcagaaggtatgccggttgacgaaatcatccgccgcgcccaagcggcaggcgtaaatttggaaaacttcagagagcggctggacaacgcccgcgtctgattacaagccgaaacgtttaaaccacaccttcaagcggcattccaccgcaacttgaaaaagaggacggcaaaccttactgccgtcctctgtccttctccgtttttacagtgggagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcagtgggtatagcggattaacaaaaaccagtacggcgttgcctcgccttaactcaaagagaacgattctctaaggtgctgaagcaccaagtgaatcggttccgtactatttgtactgtctacggcttcgttgccttgtcctgatttttgttaatccactataaaaattagaaatgcacattttcattattctcgcgcaggcaggactccagacttacccatttcagtaatgtttgaaaataaaagaaaaatcagatgtttgtattcccgcctgcgcagaaatggagacggtgctctgtcgtctcatttttgttttaatcaactatatatagctgattaaacataagaaatgccgtctgaaagactttcagacggcattcgttcaagcgtcgaactttattgcgccttggtttcggttacaaaaccgattttggtgattcctgcctgacgggcggcttctaaagctttgtttacataatcgtattccaccgccttgtctgccgcaatcgccacaatcacgttttcattctgctccttggcggctttcagacggctttccacttccccgatttccactttgcttgcagaatccccgccgacataatagccgccgttcgcatcaatcgtcaggcgcagggggtctttaggctgtttgtcctgcttgtttgtctgctcggacgcggtcggcagttccaaagggatggaatgcgtcagcaccggcatagtaatcataaacacaatcagcaacaccagcatcacgtccaccaacggcgtaacgttgatgtcggacatcggagaatcgtcgccggaattcatcgaaccaaatgccataatcagctatccttttgattaagcaggcggacgtgcaaatcgtgcgccatcgcatccaaatcctgggtcagtatttttgtgccgcgattgaggaagttgtatgccaacaccgccggaatcgccacgaacaaacccgccgccgtcgccaccagtgcctcgccaatcgggccggcaaccgccgcaatactcatctgcccgctttgcccgatattgatcagggcgtggtaaatcccccaaaccgtgccgaacagcccgataaacggcgcggtcgcgccgatggaggcaagcgcggtcatcccgtaatcaaaccggcgcataatctgcgccatactgttgcggatttgaatgaccaaatactcgttcaacggcaaagcctgcgccagttcggacgcttcgtttcggcggtagttgcggtaagactgcaatgcctcttgcgccagtttggacaaaggcgcatcgacggcgcgcactttttcgaccgcgtcgttcagcgacaaagtatcgcgcatatgccgtttgacggcggcattccctttgcgcgcccgatacagcttgatgcagcgcaagacaaccaaacaccacgttacgatactcatcaacagcatcaacacaaacacaccaatcaggacgggatcgcccgattcaaacactaatttcaaattcataatgattccaacactgaaaaaaccaatcaaacatccaagctgccgcaaaccgctgcggcaaccgcctaattcaattcaaacttgacggggactttaaactccgtccaggcattggcttgaaaatgcccgttttgcgccgccttgcgtgccgcattgtccaaccgggaaaaaccactgcttttcacgattttaacggactcaacatgaccgcccggagaaaccaaaacgctcaaaacaaccgtaccctgctcgtcattctccatagaaagcgtgggataagccgggcgcggaatgctgccgttggcgcgtaaaggattgcctttgctgctgccggctccttccccgtgttcgcctttgacaccgccgctacctttaccgctgccttctccgcgccccgttccgtctcctttggtaccagttcccttatcttccccattgccctgctcgctgtctgctttggcagaagcattgccgggatgttcggcaggtttttcagacggcttctcgaccggtttttccgccggtttcgggacaggcttcgcttccggcttaggctctggtttcggtttttcttcgggtttcggcttttcttcaggtttcggctcttccttaggctgctgaatatccgcatccgcctttttcgtaaccaccggcttcaaaaccggcttgggcggctcgacaggtttgggcggctcgggcacgggttgcggttcgggcgcagcaggcgcgcctgcaccttcgggggcgccgtcccctccgccaaaatcgcccaaatcgacaaattcaataacattgcctgactctatcacgggcagcttgtgcgcctgccagagcaatgccaccattgccaaatgcagcagtgcgacggaaaacacgactgcgggggttaaaattcgttctttatccataattcgggcataataatagcaacaattcctatttgcaacctatttttacaatttttggtcatatgaatgtctgttccgttcacaggcaaaccgtgtttaaacgctgtattacagcaaatcatcagataacgggccggcagaaaaaatgattccgtctgatttcttattccaataaaatcaggttagatgatatattgccgcttctgtctgtcagccgtttcgggctgcacaccacatctgttcaaaggaaaaccatgtttcaaaattttgatttgggcgtgtttctgcttgccgtcctgcccgtgctgctctccattaccgtcagggaggtggcgcgcggctatacggcgcgctactggggagacaacactgccgaacaatacggcaggctgacactgaaccccctgccccatatcgatttggtcggcacaatcatcgtaccgctgcttactttgatgttcacgcccttcctgttcggctgggcgcgtccgattcctatcgattcgcgcaacttccgcaacccgcgccttgcctggcgttgcgttgccgcgtccggcccgctgtcgaatctagcgatggctgttctgtggggcgtggttttggtgctgactccgtatgtcggcggggcgtatcagatgccgttggctcaaatggcaaactacggtattctgatcaatgcgattctgttcgcgctcaacatcatccccatcctgccttgggacggcggcattttcatcgacaccttcctgtcggcgaaatattcgcaagcgttccgcaaaatcgaaccttatgggacgtggattatcctactgctgatgctgaccggggttttgggtgcgtttattgcaccgattgtgcggctggtgattgcgtttgtgcagatgttcgtctgactggctttcagacggcataaacgctccagaaaacgcggcaggacatattgccctgccgcgttttcctgtagtgtaatcttatttttttcatcattattagaaccaggttgcatgataatacctttcattaactgaaacactgattaagaaactccagtctgtctaatgatgaggttttcacatcgccaaaacttgccaatcaaatgctggatttattgccgtctgagatttggtcaaatccaaaggcgacattcttagaccctgtgtgtaaatcaggggtatttttgcgtgaaatcgtcaaacgcttggatgaaggcttgaccaatcaaataccagataaacaaactcgcattaaccacattttaaaaaatcaagtttttggaagtactgccacgtatgtaggtagctttgaccgatatttgcataaaaactcctttgctggtgaaaggaattattttgccaattttaaaatatttctggcaccaaatagtacaatgacaaagacaatcatgccaatgattaaatcaggatagctagaatgagtcaataacgtcaatgctcccgccgctatcacaccgatattgatgataatgtcattggatgtaaaaatcatgctggctttgatatggatttctttattttgatttttgctcagtagatataagcacagccagtttgcaatcaatgccaaaaatgccgtgccaatcatcagttgataattgggcagctgctcagcaccgataaaacgcctaatcacttctatcaccccaaataacgccaatattatctgcgttatccccgccaaaaatgccacacgttttttatacgccagcgtcataccaatggctgatagcgccaatatatagacaaagctgtccgccagcatatctagactatcagcaatcagccccatagaattagcaaaaataccaaccgaacactctatgataaaaaacacaaagttaatcatgagcacttgatataataatcttttttctaagtgctcatcaggcttgttaaacactatcttatcaacaatcacttcggtggaaatgatatgactatcaaaattaagcggttcaagtacttgtaaaatcgttgtatcttgattatcgtgatagacggttaagcaccgcccagcaatatcaaactgtaattcataaatatcagacacatcttttaaacgcatgcgaatgagctgttcttcggacgggcagtccattttggtaatgttaaaaatggtctttttcatctatttagttccttgttttgatcaggttggctcaaataaatctgtgtttatattgctgcttggtaatttttggatggtttgagtaaattgattaggttaaaatttacctttggaagtaccgccacgcataatagtttagatatgtttataatctctggataaaaaaacgtaataagtgcttactggataacaaagtccaaaccaatagcaggcaaaataaggcatccaccccccttcttcattaaggatatatattgagaaacaaatcgcaactaaacagaaaaaacttgggagataaagccatttcattcccctattcaagaatctagccaagataggtattttgtattctacaaaaaagaaaggcatttccaagggaaacatgtcagataaaaacttttgtttattttttactatagatagaaccttgcttctcaagagaaagccattaataataccgatgacagctattaatatatagagaatagtataagtatgaataatcttcattagacaaaaagaagaaatggcagataaattacatacgatatattggaatataaaatatttacggtctaaaccttgttcagttgcaatttttttaaaattgccttgcataaaaaaatcaaaggcgtccattaaactatctttcacattagaaatttaaaagctaaataatacgacaaacaatgtgaagtactattcatggtttatttaaaaaataatactattctgaacattatttagatacagaaattaacaaattagaactaaacaagcttttaaatactttaattttattggaaagctataaaaggaactataactttacacactagtcacttctttttaagaggcaaaagggattgggaaggtcgtcttggagataagcactggtatttcggccaatggtaaatagagtttacctcaaatagggtagaacctccttcatctgtcagttaataacagccacttttacaatgccctgtcaaaataaagcggcacgcccgatttttcactcatcgtcatcaaataacccatcaccttttggggccattcgatgccgcgcaccacggtcagattcctcaaaacggggaaaaccaaaatatcctccataccgattccgccgttgatgccgtctgaagcaccgtccatcaaattttccaactcttgcaaatctgcgtttatccgttcgaggtattgggcggttttattcaaattggcggaaaagctgccgatgcttttctcttttttgtctgtaaaatatttcaccgcttccggcgttgcaaattcaggcagcccgattttgatcacgcgcggctgcaccagtttgtcgttgtatccgcccaccttgtccagccacgcccgtatctcggggcggacttcgtctttcagacggtcttcgcggtcgaaatgccgcacaatgtccaaactctcgcccataaacgaaccgtcttctttttgcaggacgggcacttgtttcgcaccgatcataccgatcggcgttgcctcgtcgtcgtttgccagcacggcttcttcaacgtccgcgccaaacagcccggcagccatccgcgcacgcacgcaaaacgggcaatggtcgtaaatatacagtttcatcaaaatattcctcgtcaacctgtcggtaccgactaccttaacaccccgcgccgcccgaaacaagtttatcttcccgcctatgcaccgtaaataaataagctgttacaataaactcgtttttatcggaacggaagaccccatcatgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaaatacaaaaatgccgtctgaaagccgaataacgcttcagacggcattttgattgccggggtttgctattttttgttgcatagtcaattaaaaacaaaatagtacaatactcaactttgaaggtctaaccatggcatactctgcggacttaagaaacaaagctttaaactatagtggattaacaaaaatcaggacaaggcgacgaagccgcagacagtacaaatagtacggcaaggcgaggcaacaccgtactggtttaaatttaatccactatattacgaacaatgcaaaaacatcagccaaaccgcagcaacgtttaacttgtcaagaaacacactttacctgtggattcgccttaaaaaacaaacaggcagcctaaaacatcaagttaccggtctaaatgccgtcaaatcggataggcaaaaaccggctcaatatgttgggcaacaccaggatgcctatctgcatgaaatcgccaaacattttgattgtacggcagccaccgtttgctatgcactcaaacagatggggataacgcgcaaaaaaagaccaccacttacaaagaacaagacccggccaaagtaacgcattatttgacacagccggccgaattttctgactaccaacgcgtttatttggatgaaacaggatttgaccgccacctgttccgtccctatgcccgcagcctgaaagggcaaatagtgaaagcgcagataagtggaaaaagataccgacgcttatctctggtgtccgcacaagtcggcaaccggctgattgctccgatggtttatcaaaatacgatgaccggagtcttttttgaagcgtggtttcagcaatgcctactgcccgcattgactcaaaaatcggtgattattttagataatgcacgatttcaccgtatgggtgtcttacgggaaatggcggaaaaattgggacataaggtattgcctcttgcaccttattcacctgagctcaacccgattgagaaggtttgggcgaatattaagcggtatctgcgaaccgtattgtctgattacgcccgatttaacgatgcactactgtcctattttgattttaattgaatatacatttgaattaattcgcacttaatttaaatgtgtttttaactgtgctttatttaaaggcaatgagaatgtgaaaatatcggatcaatcccaaagcagcctgcactttcgaaacggggtgcaggctgctttgggaatttcataaccgtttcagcctgctttattccgcaaataccgtttccaaccctaacccgctctctttcaccaagcgcaaataagccagcatgaatttataccgtgcttgagccagtttctgttctgcttgggcgacttcctgccgcgcccgtattacttccagccggttgcggatgccgtattgttggccggtttcggtcgatttcagtttcaaacggctgctttccaaaacccgttcttgcgccatgatttggtaacgcgccgcaccgctttcggtataagcctggcgtacggcgagtttgatgtgccgctcggttgcggtcagctgtgcttcggcggccccgtattgcgcttcggcttcatggattttgcccgacaattctccgccggtataaagcggcaaattcaactgtacgccgacgctcatccctttgccccgatagtggtagtcattattctgcgcagatgaagtgtagaggttattctgatagccgacatgggcagaaacggtgggatagcggctgttctgtgctgcccgaagcgcctgtccgctgctttgcagggcaagctgctgcatccggtattcatgattgttggataaggcaatgcgctgccattcatccagactgtaacgttccagcttgggcagatagcgtgccaacaggttggcggtatctatggcctcgatttgtttgctatccaggtcggtgtagtcgttcaactggttttcataggtttgtttctcagccaatacggcgatttcttgggccagggcattgtcgtaaccggctttggcttcgtgaatatccagcgcggtggcagcacctttattgaataaagcctgcgcctgccttacctgctgggcataagcctctttttccgccgcatgggcggcaacggtgtctcggctgagtaaaacgttgaaataactttcggcaactttcaacagcaattcttcgcgtgccgcatcgaaacgctgttctgcagcctgcgtatcgaacctgctttggcggtattgtgcaaatttggcagcgtcaaataaggtttgtcccacctgcacgctccatccctgtgtttcgcgggtggaagaaatcgatggcggctggcgctggtagctggcattggcggatacatggggaaggaatgcggccttggcttgttgttgccgtgcgcgcactgcatcacgctggtaatgggacgcttgaaaatcagccgaatgttgctgcgccgcccgccatgcttcaggcagcgtaaaagccgaaacggatggggaaagggatagtggcaaggtaaaaagtgaaacgggtaggatatatttggaaaaataggatttcatagccgaaaatagttcatgttgcaaatagggcgtcagtgtcaggcaaacggaaataccgtaatcttgcattatcattagattgagcaatgtcatccgggcaatggtttcaggcagtctgcatgtccgaaccggcggataacaaatgcccagtacggatccgcctatcgctccctaaagctttcgtccaatttggtttgcagcgggcttaacagataatccagcacccgccgtttacccgttttaatctccgccgtgacattcatgcccgccgtcagattcactgctttgccgtcaatattcaaggtatgtttgtccagcgacaccaccgccgtataaaccaagcccaactgttcgtggcttaccgcatcatggctgacacttttcaccttgcccgtcagataaccgtagcgcgtatagggaaagctctcaatcttcaccaccgcatcctgtccctgttccacaaaaccgatgtctttgttcaataccaaaacttccacgtccattttgtcgtcatcgggcgcaatcaccatcattttttgggcagcctgcaccacaccgcccaccgtataggtagccaattcctgcaccgtgccgtccgcaggcgactgtattgtcatcagctgctgccgctgctttgccttatccgtttggccgcggtattggtcaatctgttcgtttgcctggcgcagcgcatccagcgtatcgcgtttcaggttctgcgtattcagcacccgattctgctccgcctgtgcaatggccgcctgaatctgcctcatctgaccgcgcgtactttccaaatcgttccaattgctgaccgatttgctctgctgctccaaaaacgcatgttccgaaataaaattgtcggcccgcaaacggcggtagtctgctgttttctgctgctcgatcgcccccaccgaaaccagcttctgctcctgcgccttggccgactgcaattccgcctgatggccgcgcaaagccgactgcaattgcgcatcctgcgccgcccatgcctgatactggtgctgcgccaacacctgcgccgattgcacatcggcatcggagagacctaaagaccgtgcttgcgccatatcgatatgcggcacggtacggctttccaatgccgccaataccgcttcataacgcagtttggacaattgggcagcctgcaaagcctgctccgactgcaccacatcgctgtctgttcccacagcctccagttccgccagcgtttctccctgtttcacatgctgcccgtcgcgcacatgtaccgccttaaccaccgccgtttccagcggctggatggttttgctgcgcccgcccgacaccgttttgcccgaagccgccgccacaatatcgattttgccgaaccaggaccacaacaaagccaaaagcgcaaacgccataataaaacgcgccgcccatttcggagcggcagagaccggcgtatcggtcagttccaaatgcgcgggcaaaaacgcctgttcttccgccgtgcgtttgggcggtttcaactggtcgcgcaccgcccaaacattgcgccatacagtaatgtatcgagaaagaaaggatttcagggcggagaaaaacataacgggtataaccttggcaatatagaaacaggaaacaatataaatatgtaaaggaattttaacggaaagcgcggcagctgttaagggaaaggcgggaatattgacaaaaaatacccaagtcgttacaaatattcattattttactgcgtaacgcaacgctgaagcgcaggctgcttttgagatgcggcaaggttcggcaaaaagcagcctgcacatttaaccacaggaacaacccatgtttaccacaaacgatttacgccatttcctagaaggtttggccatcctattctcaatcggctattggggcaccatgctgctgttgctttggtttctcgtccgctttgcctataaaaagcccaaacggaaccccggcaaaatcctttcaggcagcctgaccgccgccgctatcctgatgctgtttgtttggattattcccaaacaattcggcccgatcaaagaagaaatacaggcacaagaagagtgggacagaaaatacaaagaagccgaagccgtgtttaacgaacaatgcaaaacggcgggggaaagatttaccagacggcggacaatgtggaagggattatgctgttgaaggtagtacctgagcgtaccgtttcggcagatgcaaaaaccagagacccgatgtgggacaatgcggctttacagaccagcgaaggcgtaaattttattgctcgtttcctaggattttttagcgatggggaataccgctatgtggatgtcctgcaacccaaccattccgatattattcggtattcaggtaaagatttttccgctaaatcaaatatttaatcatatacaccccgcccgttatgcggtaacgttcgaaaacaatgtcgattccaagctgcgcaggcactgggtggcaggtgcgaccatacggattatcgaccgccaaactgacgaagtgattgccaagaaaaccatctatgtctttgaaaaaggcttggacggcacgggtggggcgagaatgccgtggaagtttgctatcttgtgcaataaagaaagacttacttcttcagagccgttatcggattttgttcttagcgttttaaaaccttatatattgcgtcccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaaagtgtctgcccgaaagacgtttaatcacacaaggaaaccaaaaaatgaacatccaacttcaaggccacatcgtcggcgttaaaaaaatcaacggacaaatcgaaggcaagagcttcgactattgctgcctgattgtcgccacacccttagacagctcccaaggcaacgcattgggcagctctactactgaatacgatttcggcggctctgccaatttcgagcagttccgaaacgcccaatttccgatcgaagcaaacctgaacgtagaaatcgtcactacgggcaaaacccaaaaactgaaagtcatcggttttcaactcgtgaagaaaggctgattgaatgcagaaagtctatgttgtccagtccgtatcaacaggggactttctgtatctctctcctgaaacgggcgacatcggacataccaaattaatcaccaatgccgattatttctacgacttcgaagaagcgattaacgcaggtttggaagaaatcggcaaccaatacgaatttgtcgtattcggatttttgaaagactgattttcggatgttcggcggtcgtctgaaaaacgctccatccattaccgccaaacactttttgaaggaaaatatcatgaaatttattaacacctgccgtaaatacggcgcaaaactggctgttgtaacagctgctcccctggctttggccgcacatgcaaatgcaacgttgcccgatacggcaaaaaacgctttggaagccgcaaaagcggacggtatggaagccggttggattgtagtgggcattttcgccgcgctttttgtattttccatcgttaagagagtgatgaagtaagacggcatgtactaccaagtcggaaataaatgtcttgagaagcaccaggctgaaaacctttatttcagcttggtagtaccaagaatcaaagaaaacggacagattgtcaggccggaatataacggcagcctgtggaagatgtcggacggtcagccgctaaggcttttattggcggaatgcagtccgaaagacaacctgcaaagcggtcttgaaacaggctggatagtattcggcatcctcgcgtccgtttactttgtttccctgctgaaaaaggttttgaaatgatggatttttatttttatctcggcgtttccgtacccgtattaatcggggcggttctgtttaagaattgagcgcatgaagttatggtgtcaaaatcaggcttttaattagacatttgaggcttgaaaccatgaataaaaatgaacgtgactttttctatatatcaaattctgatttagataaattgtcagaatcttatcctgataggcctctttcttatgtgttttattgttatttgaaagaaactggtctattgaaaaatttctcaatggataaatgtcataatttttttaatagaattaattttaatgaatcttgctttgaaattaaattcaaggatgattcatttttcattattggcaatggaaaaattgatgtttcggattctaataatttcttttctgtttcttttgagtgctaaatctttttcagcagatttagaaattaaaaatgggaaattgatgtatgcactttcggaaaaatataacgataatggatttaaggcatacaaagttttaggtgagggaggaggaattcatacagaatataattacaaatttgataaaagtttgaatttgaatgtattagaaagttcaacaggcgcacgctctcttgaaaaagtccccgttaaagtaactgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccggaccgcccaaacggtaggcatcgcaaagaaaggaaagaaggcgaagacggcgggcttttgtgcgattattttccggaaatcctagcctgtcaggagatgggcaaaccttcagacggcatgtttcacgatataagcataccgcaggttatagacgataaaacatggtcttcacataactttttaccgtctaacggcgtatgtccgcagccgaaaacctttcatgttttcggtaggcaatatcaggcaagctatgagccgttatgcgtgtttgccgaaaaaatccgttttgccgtactgctcgcctttatcattatgtcggcttttgtcgttttcggttcgttgaaggggaaataaatgccattacttgccggtctgattccacttttaggcatacttctgaaaatgctgattgtcagaataatccttgcaacaggtctgacatttgtaacctatgccgggtatctcatcgcgctggaaaagttcaaagactacacgtcaaatgcgatcaattccatgccttccgacatactgaaccttcttttaatttcgggattcggtcaggggttgggctacctgttcggcgcattctcgttcttcattggtatgcacgcattcaaaaaactgacgtttgtctttccaggatgaggtagaagcatgatttatctgtttacaggaaacatggggacaggcaaaacctcccgcgtcgtctctatgattttgaacaacgaagacggattgttcaaaatgaaattggaagacggcacagaggtagacagaccgctttatttctgccatatcgacggattggataaacggcagtttaaagcccacgaactgacggaagagcaaatcatgtccgccccgcttcgtgatgtcataccggaaggcgcagtgctgattgttgacgaagcgcactacacttatccggtacgcgcggcaggccgtcccgttccgccttatattcaggaactgacagaactccgccatcacgggcataccgttattttgatgacgcagcacccgagccaacttgatatattcgtccgcaaccttgtttcaaagcatgtacaccttgaacgcaaggcaatcggaatgaaacagtattattggtataaatgcgtaacctcgttggacaatcccgcaggcgtaagcggcgtagaagtcgcaagttggaaaccgccgaaagaagcctttaaatactataaatcagcaagccagcaccaaaagttcaagaaaaaagtaccttgggcggtttgggcgttgattgcgattgtagggtttgtaggctggaaaagttacggcatttttaaagtttacagcaaagccacagacagccggattgagcaggaagcgcaaaaagaaagcgttgtgcagacgatgacggagcagcctgcatcatcagaggaaatgcctttaaaaaattcagacaatttgaaacctgaagactttgtgccgactttacccgaaaagcccgaaagcaagcctatttataacacagtccgacaagtaaaaacctttgagcaaatcgccggatgtatagacggcggaaaatcagattgcacatgctattcaaatcaaggaacacccttgaaagaaataacaaagataatgtgtaaagaatatgtgaaaaacgggttgcctttcaatccttataaggacgaacagcaaaggacggaacaggtggaacagtccgcgaaagcggacaagccgcaagttctcgtaatgggcggaaagccgtagcaaaatctcatgtacgacaactgaagagcgcggaaaaccgtttgaaggaattggcggcggagtcgtaaagcagaaagttcaatccctacccctcaggatggcttgagctgagtgaagggggttaattgctagaatggctgttttttttaaagtgtctcagtctggaatcgcttcgttcgggggttgtaggtgcaggaaaatagggcagaaaaaaggaaaagggggaagctttgtaaagattgggcgcgctttttacccaatctttatgaatacccccttttccttttttatgaactgtttttcaataccggaaacccccgaacggagtgattccagactgagatacgcccaaaaaaaatcagacattcgggtcgcaacagaaacctttaccaaaacctgcgaccccaataaaatcagatacggcaaaggcgataagcttcaagccctgaatgagtaaatcagcccattgagggcttggcgtttgacgaaacaccaagtaaagcccacgacttcgaaagtacggccaaagcgtacagcttgtaagaaagatagaagcgtgggctttcgtacatcttaagtttgaacactatctagggcaaaaagcccgaattaataaggttaaaccatgtacttaggaatagacgtttcaaagctcacaatagattgctgtttgattgtagacggtcaaaattatcaaaagaagtttcagaacaacaaaggaggatttgaacaattaataaattggctacaaagtcataaagtaaacgataagctccattgcgtgtgcgaagcaacaggcacatattacgaagcattagccgaatatctttattcaagatatacaattaccgtagagaatccacgaaagataaaaggatatgcgatagcagaactacaacgatcaaaaacagatacacaagacgcaaagttgatagcccaatattgccaagaccgaaagcacaaattaaaagcatggaaaccgccgacaaaagaacagaagcaattacaggaaatcgcccgatatttagactatctgaaacagcaacgcgcaacagaaaaagctaaacaacacgaagcacccgactatatcaaatcccatattcaaacaactatttcaaacctgacagcacaaatacagatagtcaaaaagcaattactccagttctacaaagacaatccaagttataacaatctacgcaaaaggctgaaaacaataacaggcataggcgagcaagcgacagcagtattgctatcaacctataaaagacatgaatttaaaaatgcaagacagttcacggcttatctaggcctagaccctagaaaatttcaatcaggaacaagcgtgaacggaaaaagcagaatatcaaaaataggaagttcggaaataaggaaaagcctttatatgcctgcacttgttgcatatcgttgtaatgccttccctgaatttgtagggcgtctgaaaaataaagggaagcatataaaattgatattaattgccatcatgcggaaactggcggtaatagcgtttacgattttgcaaaacggccaagatttccaagtggaaagatataaataaaaaattaaactgggctttcgccggtgattttcaatttattgaaaataaagtataaattaaaacatcaaatccattcaaaacgaaacaaacatcccgaaaaagtcggggtgcgcattcttgcaacttcaagaaatgtaaagttatttgaccgtgaaatacactatctttttttcaacaagccaccacagcaatcagacaaaagcaacccaccgccacacccatgtcggcagtacggccggacaaaccaccatccgaagcggcggggataccaccctcaaaggtgctcagcttatcggcataggcatacaggcagacccccaactacaaccctgacgactattggtggaaccgatattaactgacccccaaaagttggacagtttaatcaagcggctttcagggactgaattctgtactgaacagggctcagtccttttaatttcaacttgattctatcgttgttgtagtaacggatatattcgtgcagtacagcttccaattcggtaacggaatcatatttgcacgtatggaaacattccgatttcaacgttccgaagaaactttccattgccgcattgtccaagcagtttcccttgcgggacatactctgaaccagaccgttgtctttcaactgcttttgataaatatcatggatatgccgtttcaaatcggcatatttgtcttctgccgattggacaaccaattggtaatagaaggtgccgcgtggcagtccgacaatcaccaacagcagttcaacggatggcattgccttaaccctgcgacgagttgcgttctttctaccgcacttctttcccatagattaaggcatcgagcttttttagggcagccatttccgctttaaggcaagccaattccgcaagcagttcttccttggttttcagatagtcggctttttcgtttccggcggatgctgttttttcacgggctttcttcctttgggtttagggtttgggctttaaaccgttaataccattcaaatggtagaggcgcaaccattgcagcaagatggagcagtcgggcaaattcagttggtctgcggcagctttttgggacattccctaccccgccaccaggcggattgcctcaagtttgtattcgaccgaatattttgtcgtatgctttctacgtttgatgccactctctccgtgtaatctgtattttgtcacccatctgcgtaccaatgaatcggaaatagaaagatggtctgctgttccctgccaaatagtattgaacgacggcaagtcggaattcatctgaatattttgccataaaaaactgcaccccctaaagtcggtaaggtgtccaacttttgggatgcagttcagaagcggtctttttttgcctgccggttttgaatcatcctccgtgtatattcccttgacgaaaaaaatgatgatattacggataccaaaactaaggtcgtatccgcccccctactctccctaagcaaagagatgaaacagcgtatcggctccctgccggttgaattttccgaaaaaacgcgacgtaaccagcatcaacatatataagaacagcacaaatagcatcaatacatcaggcaacgaaaatgcagaataatgcacttaatggtgtttggatatctgttgttttgtgctgttagtaattcttctttctgtgtttacagtttagcagttgtacagttttacagtaatgtttaaacaatgactgatttattttaaatgcagatattgtagaggataaaaatggccaaagtcctttcagtaacatttttgattttttagcgagccttctcatttccccggcgagatcggcaatggcagcggtactttggccgccgatatgcttaagttcagtaaccttacgccaccaaaacccttgctagctaagggttaaacagctcacttgaaatctacttaagtctaatctaaactatccaatatggatagatttttaaacatagggcaagcagcaaaattattgtagctgaaagcacaatcactcgctggtggtctcaaacacgtgccgactacctcgccgaaaacactatcagccgcgataaaccgtgggaaaagctcgttatcagccgccgcacttggtactatcgcgggaaaccgatgctgtctgaaacgcaacaggagaaaaataatgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaacctcctttactcaccaacatccgccgcagctctgtcagtttttggcgcgctgcggcgatttctgtgcgttttagagcttcgggtagggtgtgaaacaactcactcgaaatttacttaagtctaatctaaactatccaagcagtaattagtacaaaaaaggcaaacttattttaggagtttaaaattgcagctgcgataaaccgtgggagagtctcggcatttcccgcgccacttggtacaaacgtggcaaaccgatgccgtctgaaaccgtacaacaggagacaaaataatgcttgctcaaatcgaactcacaccctgccagctaatggtttacgtaacttaaggttactggatttacgcactaaggttactgaacttaagcatatcggcggccaaagtaccgctgccattgccgatctcgctggggaaatgagaaggctcgctaaaaaatcaaaaatgttactgaaaggactttggccatttttatcctctacaatatctgcatttaaaataaatcagtcattgtttaaacattactataaaactgtacaactgctaaactgtaaacacagaaagaagaattactaacagcacaaaacaacagatatccaaacaccattaagtgcattattctgcattttcgttgcctgatgtattgatgctatttgtgctgttcttatatatgttgatgctggttacgtcgcgttttttcggaaaattcaaccggcagggagtcgatacgctgtttcatctctttgcttagggagagtaggggggggcggatacgaccttagttttggtatccgtaatatcatcatttttttcgtcaagggagtatatcgactctagaagataggtattagatactgccttttcttacaagagtgatggtaggatggttctcttcaagtcaatcaaacaggaaagtatttcttttctgtctgaagatttgaaaaaggactggatgtttcacaaggttaaaactggggaaaaagatggatatggttcagatgaaatgctgagcgtaccccgtgtctatttggaaatgatgtcgcggaaaacgggagtcccctactccagtattctttaaattctaagcagaagacttcttcgtcggtctttttttgttgtttggtttgcatggagtaaaactgtacaactgttgaagcataaaaccagcaagaaggtaaaaaagaaagaagcagttctttggattttagatattaccgcaattagtttcctttcctaaaatttgtttaaattatttgcaatattaatataaacgagatattaatgatgagaaatcaaaaaggcataatgaatatattttgtacaaaatatttgcagtatttaaaaatgttggttcgtatatgaaaagttaaaaatgccaaaatgtacagttgctaaactgtaaaactgctaaagcaacaaaacataaaaaggaatgcaaggatgcgatcactacatctttttattccgaagcgtttatgattttacggtcaactgctactctatgtgcctagcttttcagctccctattttcgaatattggaggaggcattttcatcagtgtcgtaatgccgaccaaaactctcacaaaccatattggttcttgtggcagcaacacctatccgtttgttcaagcgaccacaagagtaacatgattggctggtagcattggctttaatctcttcgatatgaactccatttttagctgcaccttctttcagcatatgcagcagtagggatgaggcaactatcttctggtggagtttgttgactttaatctgtatgcactgtaggttgagcagattcaattttttgatacagattatccggctttgttcggcaattctgtttgcgaacgtatagtagagctgtcgtcttgcagctttcaatttgcggtaggtattttaccattcaatgcgtagccgctcggtacgtttgagccaaatgttatcttcgccatttgtaccaatttgtttttacattaggctgtgttttagtaatctattgatttcaattatttgcaagggaaaagacaattattttccggttaggaataaacctatcctgttgaataccttaaagccaaatacgcctatcaacaccatattaaaacacagccttttttaatatagtagacacaatctttccctatttatgaaggtgatcgtttctttcagattcgtattttaatgctttctatttctataaaaattgactagaatagctcaattataaaaaattgcgcgattttggtatttatcatgaaaatttccagacctccggaatttaccctgttgcaacaggaatatatgcagcatctcactgaaagaatgacgcaaattgccaagctgctgaattcttccgcaaacaatcctgatatagacattcccgattttcttactgaaatcaaagattattcagaattttccgtgacagatgaaaatggaacctacctgcattgggacaaattccgccggattcacacggaagatacgcggatgaaatggcgcgccgttaaggaaagccgcaaaaaaatccaaaaaccaattgatttcccgtttgaacatcagttttggttctgcattcccgactctttgcaggcacggcttcatttgattgacaaaagctgcggcagttctatcggcacgtctagcttgggtggcttcggcagaagcgagcaaaacagattcttgctcaagtctctgattatggaagaagcgattacatccgcccaactggaaggtgcggctaccacgcgtaaagtggccaaggatatgctcaaatcgcagcgtaaacccaaaacaaaagacgaaatcatgatagtgaacaactatcacttgatgaaaaaagcggtagaattgaaaaatacgccgttaagtgttgaaatgattttggatttgcaccgcattgctaccagtaacgctattgaaaacaaggccgagcccggacaattcaggcaggatgacgaaatctttatcgccgatatcaatggtaacagcctgtatcaaccaccgccgcacggacaggttcatacgctgatggaagaggtgtgtgcgtttgccaataatacctatgacggcgtggaaaatccgtttatccatccggttgtccaagctattatcttgcatttcctcatcggctacatccacccatttggtgatggcaacgggcggacagcgcgggctttgttctattggtttatgctcaaaaacggctactggctatttgaatacatatccatcagccgtcttctgaaaaacgctcctgcccaatacgccaaatcctatttgtatgcggaaactgacgatttagatttaacctatttcatctattaccaatgcgatattatcaagcgggcggttgccgatttggagcactacatttccgacaaacaaaaacaccaacaggaattcaaagcagcgattgcccaatatactgaaaagataggaaagttgaaccaacggcaaattggtatcctgcaaaaagcagtggaagaaagcggaaaaatctttactgcacaagaaattgccaaccaatacggcatctccctgaatactgcccgtagcgatttgagtaaactgggagaatatagattcctagtgccgttcaaatcaggaaatgctttagagtatgttgctcctcaggatttattggaaaggttagaaaaaaaatagtttgctagcccagaatgcagctttaaccgagtcaaaatcaatacagtccgcaccttcaaaaagaagctgcggactgcttgctttttgctctacaaatgatctttgtagctgatttaaccaagattgtagcaattttgctttccaagcaagcagggttagaaaattcgatacttttaattattggctgtgttttaatatgatgttgataggcgtgtttggctttaaggtattcaacaggataggtttattcctaaccggaaaataattgtcttttcccttgcaagtaattgaaatcaacagattactaaaacacagccttacattattggggtgactatcctgtaaaatatgtcctaaaacgtggaaaccacttttgctctgctaaattttaaggaatctttatgttacatataccccccaacggaacctgttcgatatgttagcagtattgtagccttaaacgtgcatagtcctaacggtacaggcgactggcatagtgcaaaggcattgagtgatcgggcttaccctgaaaaattttatatttacggtgaaaatcaagagcgaaataccaatcatttatttggtgataatggcattattgatgggacggatcgactgaacaaaatgggttatttccctgaaaacatcccagtttggctcgcagatcacccccgtgcttgcgtggattatctttacacagcagtgttacaaactggctcaatcggtcgggtgattttagatgattggtttccaagcgatgaagacaagcaatcagtttatgacttacttaaccaaatcgaaccgcacttgaatactcaagaatgggagaatttacagctatggaaacgcaaaaacccaataatgtaatgctaaccgaacgagataaaaggcacgagaagcggtattactgaatttcatccgcaatacgccatgtacaattaaatcagcagatgtgtctaaacgtaccgctgttcccgtttgaaagaatttttcatgatgaagtctatcctcaccgtatccggaaatcgtatgcgtaaacccagaatcacctatttggatgtttgggcaaacgatgaaagaatcggtactttggaaaagggggccatgtatcggttcgcatacgacaatcccaattcttcgttgctgggcctgcattatcaagacagaagcaaggtatatatcagcaacaatatgccgcatatctttgcacagtattttccggaaggctttttggatgcacacatcacaagcaaatatgcttttcatgatgcgccttttgaagacaatgagatgctgcgcttggcaattctgtgcagagagactttgggtcggatacatgtgcgctgtaatgacccgctttttaatgaatggattgacgggttggagatgaaaaatccaagaatattgactgaacgggatttgctgggcataaatgcccgacaggtttttcagcaatatatggcagaaatcttccatcacggccgtttcgtcagtgtatccgggatacagcagaagatgtccttagatgccatccgcagaaataccaagcaaactgcctcatatattgccaaaggttttgatgcatccgaatatccttgcttggctgccaatgaatttttatgcatgcagaccatcaaacaagccggcattgccgttgcacagaccagcctgtcggaagattcatcagtcttattggtacgtcggtttgatgtcagtgaacagggttattttttagggatggaagactttaccagtctgcgccagtattcggtagaagataaatataaaggcagttatgcggctattgcacagattatccgacagatatccggcagaccagatgaagatttaatccatttctttaatcagcttgctgccagttgcatattgaaaaacggcgatgcacacctcaaaaatttttcagtactctatcatgacgaatacgatgttcgtcttgcacctgtctatgatgtattggatacatcaatatacagggttggaacacaaggaatttttgatgcttatgacgatacgctggcattaaacctgactaaccacggtaagaaaacatatccttccaagaatacattgttggattttgctgagaaatattgcgatttgggaagagaagatgcatcctttatgatagatacaatcgttcaagctaaagaacaggttcttgttaaatactcggatgtattgcgtgagaatgaatggttggcgcagaagtggcattttatcccggatgaaaatgaagaaggtctaccgtttacattccggtagctgccgctgtcagagatggccggtctactttcaccctgaaaatcacttcatcttatggtgtttgaaaccgagaaattagaagaatcgtattcggtaggagatatactgggaagattggaaaactggtaaatcactctattgattgagttggcggcctatatgtttaatgtaggcaaacgagaaggaatcatgtatttcatgattccttcttaaattcctgtgtcaatctaatatcaaaacacagccatctcttaccataatcatgataggtgttttattatgaaaagctatatctatagttaccgttgatttgactatgccgttttaaaacgtatagcctacctgaaaaccgcttgcccatttccttgattggaaaaattcgggctttttcaatgcgcggccggtaaatatatcgtaatgcaggttgccgccaagctttatctgcccgcgtatcccaattgctgtgccgactagagtttggcccgataaccatttggcggattgtcctgaaacatgtcctacatcagccccaagataaagctgatggcctggtttaaattgccagctcaaatcgttgcgccaataccatccccgctcggcagacaaactcatttcaccgtcgaagccacgtacggtgtggtgtccgccgatagccagtttgtcttgcgatgttagcggggttttgttccattgtgcatgaacggatgtgtcataggcaaatagctgtttaccgatttgaaaaggagtatttacatcagccgatgccgtccaaattttcatacgtgacgtgccttcgccaaaggcttcttcaggcgcgcgcagagcatctttcatgccggtgccgcgtttatatttcaacttaaaatctgccgtactgcgaccgatatattctttgtgggaaagttctgccaaccaacccgcagttttacgccgttgtacagtcagttcggcatcatcaatgtaactttttgtttccctcatccacagttttacaccgagataggttttgcgtttggcatcacgatacaacaggcggttgaagccgaaatcagtattgtaactttttccattatagtcatagacttccgataatccggaaactgcctgatggtaacggtagccattgtgattgaatgcccatgtccatttaccgaaaggggctgaataatgtacggcgtaattgtttgatccgccttctttgcgatggccgtcaaaactttcctcatcgggcgtaccgccaatcgaacgtccataatttacatagaacatatcactcagtcccaaaggattgtcggcagagaaagtgatatttccttggtattttcctgtcgcctcactacccgaattatccatccccacactcacacggtagggcagcagacgttgccgccattgcaccacgacatcactttggtttggttctccctctacgggaacgatttggagatcggcttccgcagtcgggagacgtttgagattttccagtccttgttccaaatcacgcagattcaacagatcgttcgagcgggtgggaaatttgttctggaatgctgcaatacgtcctgcatgggtttgatcatcgttagaccgatcgattcgtatggagcgcagatagctcggtatcagggttaattgaagcttgccactattcaaatcctgtggcgcagccaagatacgggtcgtggtatatcccctgccgatcaaagcattttgtgctaaggacatgatttgattaatgttgcccgcatgcagacacttgccagcctgaaaacccgtttcgcgcaaggcacgttttagggcaaactgaaaccgagcatggtgttcgccttccaacaccacttcgttaatggcaaaacacggttggctgctgtcatcgcccatcaactgattaaccgtttcccccgtgtttttttgatgcaaacgcacatcgctttcaggctgcatggtttggcgcaactgctcttcgcgttggcgttgctgaatatcttgctgcatacggatttcggcagggttgggggaggccaacaaagtagcaggagcaatgatacctgccaataagcagcaccaagacaaaaagcgaatattaggcaaataggataaaggaagtttcatggcatggtcgcaaaatcaataaaatcatcaatgggcattcaatacacgattgcatcaagttttaaaagttaaaattctcaaacccttatcgctccctttatgatacaaggcgcgtactgtcgtactaggaaataactggcgcacagctgagcgcatttgatgactgtgtcccaatggcgcaaaccattgaatcagccaaatattgtcgccacagttccaatcgctgttgtcacgcaaatggcggtcagattctaaataatgcgcctgcgccacttcatcaaaataagcccatgagatataaccgattggttgggtacccttgcaaaacaaagcgaactgcccgttttttaacacaggcaatatatacgtcatcatctccacaataggtacttggcgatgcgtaggcgactgataccatagccaagtgatggcaccgagtgcttcgctttcgttccattgttcattggggtagagtttaggagagatgatgtttaagggtggagtgatgggcatattttaagttagggttcgtgttggttaaaacaaaaaatggtttcagcctgaaatgaaatatttcacgttaaaacatagttttagcacatgagactgaactgcgtgggcaacgagttgcccaccctaccatgtaacagttcgcattaattgcacaggctacgctggttattgcacaaacaaatgaccatactgcttatctttacgaatattgtatccaccgccatggtgaatacactgataagaaatatgttgcccaatttcactaaatgagacttcggtaatagatttatatcctaattgattgcctaattcatgcaaaacaaaggtgagattttcagtttcacatgtgtcaacggctttctcccagcgtggattaagtttggagcaattccagtctgcacaactaccccaaaaagggcaagctgttagcattgttgagcagaatgatattagcactaaattagaaagggttttcttcatatctctctcctttataagttattgtgtgttacaacataattaggatttttaatgcactgatagtaaatatccattactgttttgtttttgtacttttcttcatcattctcaaaatagatattcagttttactaatgccttatcaaggcaattcataatttcttggtgttccttatcagtagttgtccagttactactagtaccgtacaaggctgtaccgactacgacagtacctaataaggtagtagcgcaagctgttagacaaaaaacagatgaaagaaacagagaatatttagaaagcttctttttcatatttttcattatcttttgttttgtttggttctaccagtatgggtttagatttgttaattggcttaccttgagcgtcatattcaacttcaccccatatttttacatagtcatcaaattcttttgtacctgcttttggcacctccgcaaaataactgctatgcgaatagcacaaccccttacatgtaccttgtgtggtgtcattggttcctagcaagaaaggtatccatttgttccccacaaaatctttatcatgcacgattgagtaggatccgctgttataagttttgccgtctgcacccgtataggtatagccgtttttctgtaaaacatcggcgtaatcattctgcacatttgtggctgtaccatagaaacgtgcttttctgattggggcaatgccattttgtttttgattgtttacccaatcttttaaggaaacgcttgctgtaattcccccacgactgtgattactggtatcaaccgaccagccgttacccattttttgaacctctcgataaatatcttgattcagtttttctgaattggttttgggtaaatagccttggaacactttattatttaattggtcgtaaccgacatacatcagttcagaaacaagacttgaaccgagccataaaaaatcttttattttgttattagaatcagatttatatttccctgttggaggattcatgactgcaataacaccactaccgtttgtactattacgattttgttttgctgcgttgcttaatgaatcttctcgattattgaaaataccaggattagacacagtaataactttgccatttgtgtcttgaatgcttgccagttcttccttgcttaaatcattcaatgaccaaatttgtctggtatcaaaggatactttacctgttttttcatctattatcttcttatggaaccacatttctttaggtgcagttgcagaccttaccgctctatcggcttgggttgtggcaaacatactccaagccatatcagaactccctgctccccaaacgagtcctaatcctgaatcctaggcggtaatgacgaaggatagttttacaaaagtttcggcctacaatttataggtttataataataaaaatatccatcaaaaaaatgtgatttttctttttttaaaagttgcatcttgccattcttgtaatcacattcgtaatattcaacatttttcaaatctgaatcaaatagatattgaggtaaaacattcccttccttatctagttctattaattcctcaaaaactatcttacttttatgataaaaaacaattttttggaaatctgaattgattatatacagttttacataatcccaattaaaattcgttatatcactaattaagaattcttttttattataattaaaacttatttttcttattacattcttttcaaatataaagaaaataacaatagtgattaataaagaaaatatataaagtatatttttattcatcttttatcttctccattgtctggctgaaatttgtgctctgatttgttttctcctctgctgaattttaaatccggcaccagtattatctaagtgaatcaatatattgcttgtattctggtaatctttttcagataatctttttcttacaacatcataatttccattactgtttctttctgcttgataaaaaccattatttttataagtttccagaattaatccaactaactcttttgtgtttaacctattggtatttaatgctatttctcttcctatttcgttatttagttgatcaatcatttcatctgctttatctaatgaaagattacgtcttatagaataattaattttttccccactttcatgactatttcctactttaacagcaatatctttgccaaattctcgtgtgatggttgcttgccataaaacgtgcctgaatgcattgccaactccaccttcaccaccaaattcactattaggaaataaatttaattgaaaagttgaagcaattgttgaaatattaggctctaatgtagagccaggatctttatgtacagatccaattgcaatagcaattctagggtgcctaagagcaaatttcacttgctctacagtatcattattctccaccgcactttgcgcattcaggctgccttgcgctgcatctgttgcgctgttgccgactgccgcacccgtagccgtacccaatacatttgtaatcgctgttacagtctctttctcttccgccgttaagtcgcttcctttttctttgccgtataaccatttgctgatgtaaggcgcagccgcttccgacccgcccgcactcaatgctcctgctagagcattgttgtctcctactgcggcaaccgctgctcctaataccgcgtgggcaagaacgtgtgcggtttcttgactggcggttagtttaccattcgcgttttgaccggctaaatctttaaagtgctgtccaatcgcatacgatacggctggcgatgcggtagccgcagcgatgcccgctccgctttgggtcggcgcagctaaacctgaggctaacatgttgagaatgactttgccttgttgccaattatctgcttttgctgccgcatcttgagcttcatgggctttgcgtttggcagtttccatatcgccattggctaatgcctcggctgctgctgtttcggctgcttctttgtctgctttgagtttgtctaaatgttggttaatctcggtattggcttgttgaacatttttactaaaatcttggctgacggttctttgtaaatccagttcactttgcaccgcttctttgttgaaggtgttcttcaagctgcccgaatgtcgttcggcggtgtctgtggttacgtttgtatcaatatcggctttggtttgtgccgctgttttgcctgtcagccggatttgtgcggcttcgtcggtgatttgaatgttgcgggtgttgatgccgctttttgtgatgctgctttgactgtcgctgtcgctgccataacccactgatgaacttgcgctgtttttatcggctacgcttgtcaggtgtttgttttgaggtttattttgtgcgccctgtcccagtgttttgccgcttatggacgcacttgcgcccaatccaaaactttcgcctttgtattggctgtggtttttgatgtcgctatgggtgagggtggccgtctgaaagcggtttttacccttgtcttctgcgctttgggtactggtgatgatgccgcctttgaggtctgtatggtttccgaccttgatttgatagccgtcttctccggcataaataccgctttgctcggttactgaaacatggtcggctcggattttgctttggctgtaatcgccaccggcactgaagccataacctacggtaacttgtgcactggcgttttgttgtttgctttgataggtttctctatcttgtacgctttgaatacttaggtttttggcattgacttgtacgcctttgccgcgtacttgcgcgcctttgatggtagtgtcgccaccgctttggataagggtttggctgcctttgtcgccgatatggctatggcggtgggtgatgctgtcgccattgccgtagcctttgccgacattgccgcctgcggtaacgcctaatgaccagcctccttgtccgaatgatacggcagcacctgcgttccagcctgccgatttgttttggccgcgttcggtattgctttgctcggctgattggagtgtgatgtcgttatcggcaatcaggattgtgcctgctttgccggcaacatctgagcctgcgatgttgatattggattgttctgctgcgcctgtggcgattaatgtggttttaccacctgcttgaatttgactcgcttgggcttgattggcttgaacttgggtggtttgtcggttttgctgttcgccgtaggttatggagatgctgacttgtttggcattggttgtaccattggctaagttttgtgcactcttacctgtttgataggcttgccagcctgcattggcagccgccatggcattaacgcggtcgtttttgctttgtccgacttgtttgctgctttgtgctacggcaatcgcttgttgtgccaaatcggtaacgggcgaactgaatgccaccgttaggcctttttgttcataggtttgggtggtattactgtttaatttgttgtgtgccgcttgaatgtctatgctttgggcatagatggtattgttgccttccgggctggaaacggtactgccgatttgttcgtagtgtttgcctgcaacaatggtggtatcgcctttcaagctgcctacggtactgcctgtatgttcgttgctttgggattggttttcttgtgtgtttgtcttgctgccaatagtgaagccgatacctgcactcatcaatcctgatttctgggtttgatgataggtttcgctttggctttgagtttgggttgtaccaatgcgaacatgattgcctgcttgaatctgggtgccattatcggaaataacattgctgccaaggatgttggcatcgtttcctgcctgcaatacaacttgcttgccttcaaaggtgctgctttgggcggtttcgtgatgactttgggctttatcggtaatgactaatttattgccaccaccgcttctgcctgtgtgtttggacgcatcatcaacatgggtcgtgttgatgcctgcgctgatgttgatgtcatttttggcagacacagcgagtgtaccgtttgcgctgctgacttcggcagctttggcattgaggttattccctgacaatagggtaacatcgccttttgtttgaatgctgctgccgacttcgttcgttgaaccgcgaataacatggttatcggcatcaaaatgggttgcttgatgtttgctggtttgtaccgtatctaggttaatgtcgcgccctgcttgcagccgggtttgcccttgctctgattgattgctgatttgaccggcaatgatgttgatgtcttttcctgcctgcgctgctaaaacacctttttctttgcctgtgatataaatacctgccattcggtctaggtaggtgctgctgccttgtgtattttgactgctggcggtggtgctttggctgttgatgttgttgcctgcgttgagcaataatgtctgttcggcagaaagcatgccgccaatattattgatgtcttgtgtggccgtaaccgctgatttttgcgcatgaatacgcccaccgatattgtctagcgtatcggtattgataataagcgcattgcgccctgcaatcgtgcctgagtttttcaggctgcctgaaacattgatttgtgtattgctgcctgacaacaatgcacctttaccgtctatgtcgccatttttaacgcgtacataaacctgtggcaccaatacggtttgtgtgccgccatcaggaagcttaacttctttttgtaccaaccaaacaatatcgctggtcagttgcgctacttgctcggcacttaatgcaatgccaacgctgagattcatcgaacgtgccgcagtcgcgccattatccattaaggctttaaattgttcttcgtcgttttgataaccgtctaaacgacgatgccctgtcagctctgcgatttgttcattgattaaacgttgctcgtaataaccatcacccaaacgtttatgtaaattgtttgggtctagtttgaggctgtccagcatatagtcactacccaaccattgacggtagttggcaaagcgtggatcggtttcaacaagatagcctttattgacaggattgataatgtataagctgctgctgggtaatggggtaaaagaattggacgtatagggtagcgaaataccgttgctttgcggcaactcagtgccttggctgggcgcatgatggcttaatgctttgcgatgcgattcataggcaaatgaacccagtgaaatgttgcgtgtgatttcctccggcaaagtgtaattttgttcgctatgtcccgttgagtctcgtcctttatgtttctcacgccaatagctgtgtaatttgccattttcactgaatactttcttttcgccaaaggtttgctcgttatgcaaaccgtctttttctgtttgtacaatgagattgccaccagcaatgatttggctatcggtattaaatacttctttaccatcaatggttaaatcattacctgaaatgattttggctggcgcagtttgggtaacttgggttttttgggtgactttttcataatcgtatttatgccaattttcatgcgccgctccatcaggggtgcgtaagtggtctgattcatcgttatagacagaccagcctaattcatgttgcgtgccttctcgcaataattcgtgtcgtccaaatgcttcgtaatcaacaatatgctcgcgccctgtttctaccaactgcgttttcaaatgctcattggtattgtgcagcttttctacacctaaacgcattttgcctgcagcttcaatggttgcgccggcattgtgtatcctttgggctttgcctgtggcttggccattggtatctaatgcgccgccaaccgccatatcgttaccgctgtaaatcagactgttttcacggttgtttaattgtccgatgcctaaattcaggttttcacgtgccgcaatggcggcacctgtaccgttttcatcttgattgtctaagcgggtagccgcaatagcgatattgtcgccataaatccgacctgtaccgatattattcatttgcccggcttggattttggtttgttgtccgtcaatcaagcctctattggttaaattgtgctgcgtgccaatgtctgtcgtaccgccggattgaatgttgccttgtgctgcattatcaaggttatttgctttaatccgaatgcgttttcctgcttgcaaagtatgtgaatttttcaggctgcctcgtgtactgagcgacaattcattgcccgccacgatattgcgttctacataaaaatcatcttgtaacgcaatatccagtttattatcagcggcaagtgtgccgttgttggataacgattttgcctgaatagcaacatcacggcctgattgtatcgtgccattcgtattatcaatgacagcggtagattgctgaccatcgtgaataatcagttgttgattggtcgctatttcgccattttgattgttcaggctgcctgaaacggctaaatccgctatttctgctgataataacttgccatgagcgttatccagttgatcggtttcaatctctaactgttggcgtgttgtgatgttgccattttgattattcaggctgccggcttgaatgtggaccgcatcactgataattgttccattgtgattgtcaaacgccgaaccttttgcatttaactgatgaatgtctatttgtcctgcattatttaaaccttgttgcgcactaacatctgtttgaccattggcaataatactgcctgaattatccagtgcaccatgagtgcgaattgtcccatcagcaaaggtaggcgcagttatgtttgatatagaaacggttgcagtacccgtacctgttgccgttgttggtgtggtagtggatgaatggaaagatgcattgtaactattgccggtttgattgcttgaaccatttgacgcggttggtgcggtatcttgtaaacccatgcggccacggttatccattttgccttgtgcatcaatatggagtttttgtgaacctgtttgagagagtttgccttgattattaagtgtgtcggtatcaatagccaaacgagcggcttcaatggtgcctgatgtttcatttttcaggctgcccgaattgtgaatcaatatttcgcctgaggacaataatgtgccagtgttttgaatcgactgactgtgaatttgagtgccttgttgcgataccgccgtaccgctgttttcaacgccctgactgcggatattgactttgtgttccgctgtattatccgtatctttcgcattggcggcagccatcgtgccactattgactaaacggccatttgcatcaatcgccacattaccggaagaagcaaacaactgcccttgattacgaatgcctgcttgctcggccgtactgatcaaggtgattttgttggcatacatacctcctaatttgcctgtatcaatcgcaaataaagggatatgtgtgccgttgttggctgtattgtttgacgtattggcagcagcattattgagaataggcgaatgtgcattacctgttgcgaccacatcgttttgtcccgcgacgacacgaacatcttgtccccatacgggtgcatcaattttggaatgataactgagaatacgtgtgaaatcggtatcacgggcatccaaaccgtgtccggcgattacaacattgccttgccttatcttaaagccgctaaggtctcctgcttgatattgcggttggcctgtcgtcaaagtggcacgggaagcattgataaaaccaccaccattgactgcaatccctgccggattggcaataacgacttctgcacgtcgtccgcccacttcaatatagccattcatttgtgaagaatggctgctgttgatttggtttacaaccacacgtgcttcgccccttgccaaccaaggattaccttgaatccaaccgcctagctgtgtttgggtgttgctgcggctgttgtttaaaatcgccccgcgattacccacatcaaactgggcgtattgattaacagaaacccctgccgaagtaggggtttgaatattgacttgcggtatgccgttacctgtttgcagaatcgtggcttgttgagttttaggagcagctttatcagcaataatgccatcagcaaaagcaatattggccgtacctacagccaaacataaagaaaagcccaataaagaaaaagaaaagatatttgaacgacaaacaggtgcatgagtagtaccaaaaggaacagatttcacatgagcgctgcctgaatcactatcggcacagcttttaccttcgcgcttggtagtttcagcaacggctaccacagccccacgtttgcggttgaaaattacacgatagagagttttattcatgatttcagttatttgatttttatagagttattagaaaaaattggatagtctgaccattctagatcaaggattttggcgagtcaattaccgccattttactgccatttgtttattaaattagggactttactagataacggttaaaaatcccattcgaacgaaatggcaaggtttataccgtcgttgtccctaatgcgcaatcagcaacattattgccgattatccgagagaaagttaagtctgatggcattgtgtatacggatacctttcgtagttatgatgtacttgatgtcagtgaatttagccatttacgcaagttttccagtatttgactggcaatttaaaacagtcggattttgtcccatttgttggccaagtctttacttgcttggccgtttgaatttaaaaagcagtctttctactttccgacctttttttctgttgtaaggtctataatccaatagcattcccaaagagcattttggacggtggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatctaaggtcatctgaaattaaatttagttttcagacaatctttttcttcaattggaacgtggagttacattttcacctaaactatgcacgctagatttatagataaaccattcagacagtccaataaacattatggttgggattaccaaataccaaaaactaccgactctttcagatgaattaaataaagaaaagtacccatatgtataaaaaacaatgaaggttaatatgacagatacagcaagttgattttgaaatacccatctgaataaagttgataatatcactggaattagaaaccataacataactataaacccaccccctaccatcccaaatataaaatctattacccctaaaaaagatagtttaaaatcattaccccataaacctgaaaaaattaaaaggccaaaaaatactccacctattaagaaaatagatttaatattttgaataagataaaataaataatttttattcatggcttgcatccctgtttctcagaatatcccataagcttacaaccatatttaattctagatttgtaatctaacatattaattccatcctctatttttttcctctcatctaaaggatttggaattattgaaaatatcttatttgatgttacccctttaatcaatgacaaataatccttctcattactcaaatatttttggtgaataggctgtaataacttttgctcgcttttcaactgttgaatatcccactccctaggattagtttttttattgaacaagtctctaaaattataaaatccatttactatcagtgcattgcctgacgcagccctccattcataaattggaggattaccaacaactttacctgccgcaaaagttatataagaagcttctccgtctgcccctaacccagttatagcagcacgcgatacaaaatcagctccaccaaaccatcgtgcttttgaacccaaattttgctcataaagattgctggcagcaaagaaatctgcacgattgtcaatggtgttgaaatacttgtcaaatcttgtagatgccccttgtgagttatataaatagccaaaaacttctttggcaacccgtgatacatccgtaggcatatacttccacgcagcaggcatggcaatatatttaatagacatattaatgccgtttctgcaaccatcgcccaatgggttcctagaacagactttttgaatttccgtatcaattactttgctaaattgttcatcctttttgatggcatttactttttccatcgtagtagaacaagttttaccggaaaggcattttgtcaatttatccattctttccttgctaagcgcattactctctaccgccacagcagccgcattcgccgcagcattcacatcccccttactcaacgccgcaaccgtccctgctgccagcttcgccttagcaatgatttttgcccggtctttcacattcaggctgcccgggtctctgccgtccagcagggcttcgccgaggatttcaccgaccgccgctcctatcgcgccatcctgacacttgcccttattcgccgccgcagccgcacagcccgctatggcatgggcaatcttgtgggtaatgtagtgctgatccaactgtttgattttactggctgcttctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgagcgatacggaagcctggctggccagcgaggcgaatgcggcatcggttgccgctgcggccgcgccgtttaagcccagtgcggctccggctcccgcgcccgcagtaaccacggtaacagccagcgcaataatcgctgctccggctccggttaagccttcctgtttatagtcccatttgtcgtacgccagttgtacctggttccagttgacgtctttggtgacttggagctgtttcaaatagcaagcgtagggggtgtcttcagcacgcacgcatctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagcttgctgctattcatcaaattgcggccattgaaagtctgttgttttactttcacctctcaacagtctaatcatatcgcttttgagaaactcaaaaaaatttttaatattaccaacatagagcatagcttcacatagtgaactacatgcagatttaatgtcttcattgtcaatagcatattgatattccttcatatgctgaaaaaaagaatcaaagtcttcttctaattcatcattccaatcagatgaatagttagaaagccattgtaagtcaagaggatcttcactattcaatttttcagttgtggctttctcataaagatcaaatccttgtttaattcctaactctcttaaactttcttttactacattaaaatttttcatctgaatcaccttatttaagattcaattttcgcccttgccctgctaatgtcttagcttaattttgagcgagttttaggtttcatgcagactacagcttactcagcacacacgagtctaaacagtatacagggaatctaaatatttactttcataacaaatgccgtctgaaaaaattgagcttttcagacggcatatggccgtaaatcatggaacgcgtatactgaagcccacaccttatgcatgggttttagatttcatgcaggctacaacttgctttctattcatcaagagatggccatgaaaaactattctttttatactcagcactcaataatgttgatatatcagtttttattgaatcaaatataagagatagattacctgcgtaaatcatagccataaataaagaattactggcaattttgaaatttttatcgtttagggctaattggcatacttccatataatctaaaaagttttttaaatcctccttaaattcattatcccaattcccgtctgaagtataatctttaatccatttcatattagctgtttcatgattaacttcttctgatacttttggatctgtcaaatcaaacccttgataaagccccacattaatcaagattttttttatatcattcaatgtttccataaaatttcctattttaagtttaatttacgaccttttgctgccccagttttcatttggttaagcgaaccatccatatttagaacaaacttaaagttcccatttttatcaaaaacctctaaatgatttttatgttggccatctaaataaaacctatcaccggtttttaataacccttggtttctttttaccaagaagacagactgcccttgctgcgtcggaagcgttgtcttttctgaaatttgagccagctgttttccaaaaggattatttttcatgtatgtactcatattcggtacagcacctttattagggatataaggacgatttttttctaaaacttccttgaccttttgtgccgcttcccctttattagcgcgattcagctctgttccgacgacaatatcaataacggctttggcatcgttccaatccaatgtttcgtcgaataaggtggtcaggttgtcggctaaattataaccttcgtctttcaacgtctgttttaaatctctaacgttgattttcccgttttttaatccttttctggctaccttataaaccacttttgcagcagttacaacagctttaaccgcattattttctaccgcgttttgtgcggtttgtgcagcagtattgacatctcctcccgttacgcctgcaactgtacctgccgcaagtttggcataggcggtaattttcttaacttccagatctaattgttccggggtcatatcgctaaaatcggtatttttaaccaaagcctccccgacaatctcacccacagccgcaccgatcgcgccgtcctgacatttgcccttattcgccgctgcagccgcacagcccgctacggcatgagcgattttgtgggcgacatagtgctgatccagtcctttgatcttactcgccgcctccccatgcgcggtattcaccaatgccgccaggatatttgcctccagattgtctttcaggctgccgccgttaacagcggtgttgatcagcgcggcactgcccgcattggccaggttaacgttgaggttgtttacccaaggggtttcgctccaagtggcaagggaagaggcaccgagtttgttggatacgcctgccgttgccgccgctacaaccagattttttaccgtgcggcttctgcccagttccttcagggttttgccgacatcgcctttattgttgatgagcgatacggaagcctgagaagcgagtgaggcaaaggcggcatcggccgctgctgcggctgcgccgtttaagcctagtgcggctccgactcccgcgcccgcagtaaccacggtaacagccagcgcgataatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcagattgcctttggggatgtcgacaatgtagccgccgggagcagagagtacgggcgcaacggagcctgtgaaacttggcagttgcaaggtttcgatattgctgccgcgtccggcctgtttctgccagagggcagatttgctactgcttactgtttcagtgcgcacactacttttgatgccttcaagaataatcttggcatctgctcgtgcctgatcgcctacacctgcacggatggctgcgccgcccagcgtggtttcaaactgggtgccttgcagtttggcgtcccagcctgattgcaggttggccgattctgcaactacccttgagggcagggcggttttcatggtgtgggtggtggtgtcgtgcaccttgtcgtaggtaatgccgataaatttgcgcttggtacgggtgtcaagtttgtcgtagttgagatcttccacggcatagagaaccagcccacgtccggcttcgattttaacggagccgcggggtgcatcaaacaaggtggcgtgggcaccgatattgccgccggatttgatttcaataccttgtgacgcactgaggctcaccgggtcggctttggcgtttttatgctctttgatttcagtaacatgttttagtttgtaccacttaccggttttatagctgcgtttatcgaaggtgtagagctcaccctgtccggcgtagtagaactggtcgccgtaggattgcagtttgattttgccgttttccgaactgatatccgtggtgctcagcaggatgcggctgttttcattggcatacggcgcgctaatgctcacaccggttttacccgaaagttctgcagcaagcgtaggaggtgtcttcagcacgcacgcgtctgaacagtatacagagaatctgaatatttacttgcataacaaatgccgtctgaaaaattgtgagcttttcagacggcattgagccgtaaatcatggaacgcgtgcgcgctgaagcacacaccttacgcatggattttaggtttcatgcaggctacagcttgcttccataaatcatttttatcagagctcgtaggtacggttagccgcctttagcggcgtaaccgtacgaatgaaatgccaagttgcaaggccgtctgaaaaagttgaaaaacagatttcagacggccttgttattttataaagtttgctgatatgcgtacggttacgccgctaaaggcggctaaccatacctacgcttgctcataaatatcaatattcggcaaatcggccaaatctattggacacgcaatatcccaccaaagccattctaagtaataccaagggtcttcaggccatattgcttgggcatcttccaaagtaggccatatgtctttcaatttctgcacttgttcttttgaagttccagttagaggaattccgataccgtcggtataatcatgtaaacggattgaaccgtcatttaacagttcttccataaaagaacagaaattgttttttaagttttcatcttgaatattaatacccatttgatttttataagagttaaaaattgaggataaatcgatttgaaaatcaagaatcttaattttttgtttctcatccacggtaaaatcctttgtaaattattggaatttaagctccaatttagtacctttaataaatgatggaggattctgcaaatctaatgtccatcgtgcttgagttgaattctctgtttttgaaaaatttcttaatgcaatttttgttcctgcccattctccagtactgataatgccatttgctaatcttccgtcaggcaaaactctaaaattcggattctggccagtcatctgccgataaagcgcaaaaatctcctgttcgcttacgccgctgtaaacgggtgctccctttaagcttatggcttgtacaggtttgatggtttttccgttaatggttatcggaatattacttgcatcaagcaagcctgctcctttccttactctattgttaaatcccgtcttccatgcatccagttgcgtatcgcgttgggcaatacggaataaaatctgctgttctgctttggctaaatttgccaaattgtttattgtttctttaggagcagcttgcttagccgccttcgctttcgacaacgcccccacaggcgcttcccaagcgttgcctaccgttaccgcacccgtggcgattcccgcgcccgcttcggcagcctgagtgaccatgacagtacaaccagaaggattagccatgcaggtgctgatagctaatttacccgctgtaccgatcagcggagctgtccaacctgcagcataaaccccatagctggtaatcacaatcgggcctgtgatgccattacggatattgcttatccaaatggcagcatccttatcctgcggattagtcatcgcacctgctgcatgtgcaggcataataccttggataattttttccagtgcggttttgtcgggcttctgcggttgatgctttttcgcattggtaggggtactgtcaaaattcaaagcattattcactaccgccacctcagccgcattcgccgcagtattcacatcgccgccgttgagtgccgccacgctgccggcaataatcttcgagtaactgataaccttatgcttttccgcatcgctgagtgtagcagggtttctgccgccaagcatggagtcggctacgatttccccaactgctgcgccaattgccccgtctttacattttccttgtaccaatccgctaacacacccagccaaagcgtgggcgaactgtttggcaacataatcgtcgctgaaggttgttttgattttgctggcggcttctccttggaagctattaaccaatgctcctaatgcggcattgcctaagttgtctttcaggctgccgccgttgacggcggtattgataccagctgagatacctgcattactgagattggtagccagtctgcctccaaggttggcaatagtttgattgcccgtactgctgaacagttcggttcttaccttgctgttcaattgggcaatatctgcgcccatctgatttaatgcacccgccgtcagggcagaagtgacaatctgcttgaccgtatcactggtgccgagatctttcaacgctttgccgacatcacctttattattgatgatggatacagctgcttggctatacaaggaggctaaagcagcggtttgcatggcagtcgctgtagaaacggtagtagctgctgctgtcgttgtggcggctgttccggcagctgcggctgtactacttcctgaagcggctacaccgcccgctgcggttgcgccgtatccataagtcagtgcggttacgattatggtaacaatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcaaattgcctttcggaatgtcgacgatatagccaccgggggcggtcagtttgggcggagtagggctttcgaagctgggcagtttcagcgtttcgatagtgctgccgcgtccggcctgtttctgccatacggttgagttggtttctaatttttcttccgactggatacggttcacaatgcctttgaggataattttcgcatcggcacgggctttttcgcctacacctgcctgaatgtccgcaccggccagcgtggttttgaattcggtaccttcgagcacggtatcccagcctgaacgggtggctgcagtttgggcgacgacgcggacaggcaatttggtttcgttcagttcgtttttactgtaattgctcttgcctaccttgatgccgataaagcggcggcttttttggacatccaactcgtgcttgtggatgccttcttctgccagcagttgcagctcttcacccgcaaccagggtaactttacctgcaggggcattgaagcgggtggtattagcttcgatgttgccgcctgcctgaagcgttatgccgttggcggtcagctcgacgggggctggcataatcaggtggtcgcgggtgctggtaaacttggtttttctgatgattttgccgcttttacctttggtttttaagaaggtataggcatcgttttgtccagcctccagtacaatatcactatgggctttgatgtctatgctgcctgagggagctttgatttcggatgcaccgataataatacgtgcatcatcgagtgccgcagctgcatgaatacttacccctgtacgtccggtcaaacgtgaaggcttgttcagagcagctttgtcgtagtgactcttgtaggtgggcttgccaatttcatattggtcggttatgccgtcaatcagaatagcagccgcctctgaatctgctgcctttggcaatacgcctgcggcgtgaaggttcagttttttggaagcggtaatatcggaaccgctgatttcgatgccttgtgcggaaatcaagtcaatattttgtgcagaaagcttggcttgcaggtattctttgcctttgggttttttacctttaacttccttgttgatggcttgaatatagaaagcgagacggtcgcgttcttcttgcagggttggaatcagcttgcttttaggcgagctttttttcaactgcgcaatctgctgttccaattctttggatttttggttgagttcagccgctttttgtgtaggaaaataattgctgaatgagttgtttacggcttcgatattcaacttgcctttggtggtggcgacaaccaagtttttaccggctgtaattttagaacctcttaaatctgtttctcctgtaaccagacggatattgccttttgcttccaatgaggaaacttgagcactaggcgcacctgcatttcctccttttgcagacaacagcaattttccgcctgttttgatgctcaggtcggtatgcgcactgatgcggttggcaggttcgatggttaatgtgccgctacctgcttcaatattcagccgtccggccaatggttttaattcggcattatcttccaaagttttggtcgaaacggtactccaattgatgttgccgcgcttgactagggcggtaccggcagtaaggttgattgcacccgctctcagcgtggtgttgtcggcaatttgggaatagcgcgcattgagtgccaatacaccgttagccaccagcttgttggcagaaggcagtttgtcgttttgccaaatctggctgccggtaatgcttagatgacggtgtgcgtaggcatctacttggttgagcgttacccgctcgtgttgtgcattaagatgcgtattatgggtagactccagcttggtattttctatgctcaatgcccggtcggaatgaatgttcaatgccccgcttttggcatggacgttaaggttttttaagtcggcattaccaccgttgtttttgatgctgatgtgttttccgttgattgaattgcgttgttttccgtcaccaagctgaataccgttgccggcaaccaacgtaatatctcctgaagatgaagtgatattggtattgtctgctttcagacggcctttaccaaccgatcctgcattgacatcggccttggctgtcagggtattgtgaccggtaaagtcggcattaccgttggccaataaggatacatgaccgtctgcagaaacagcatgaaggccgtctgaaacgatattgccctgcaatgcggtggtttcgagagccttggctgcgttcagcttggtattgcgaagctgaatattgcctttggctgcctgaatgtgcagattacccgagttggtacgcagattggtattggtaacattcagcgagcctgcctccacacccatgtcttttgaggcagtgagggttttactggtgccggtaatatgggcagcgttatccgatttcaaatggatgctggcggcagacaaatctttatcaacattcaaattcagatctttacctgtatgaacatacagattgccgggagtattcagattggtagttttggcagtaatgttatcgtctgccagtaaagcaagctgcttgccgcccttgatactgcctccgtttaagcggatatcggaggtaactgttgaagcttccaaagaaagcggtttgcctgcttcgatgtgtgcggtgtctttggcatctattacggcggaactgctgatggtgccgttggataatacggtaacatctgccccggtaatgcgtgtgttattgcctaattcggcgttgcctttgctggaactgtatacggtagtgccagtctgaatactggcctccttgatgacggtacggccgtcggccgacagagtagccgggcctttggcattgttcacattagttttgctctcaatcaccaaattatgaccagcatttaataccgtggtagctgggcgactgccgttattctgcaccacggctccgttacgcaagctgatatcttctcccgtctcaataaccaataagcctttgctctcgatccgaccaccattggagataaatgtgcctgccgctcctttttcggtggtttcgatggagagataagtcggtgaagcttcggtgccgtcggcagtggtggcgatgcggccgctgttttcaatgcggcctgacgaagtcacaatcaattgcttggccgcttcgagtgtgccggcatttttgacgcctacgcctttttcattggcaatcagtgtgatgctgtcggcgtacataccgcccagtgcggcagtatcaagggcaatagtcggtttcgtacccgctgccgtacctgcactgatttcgccgctggcgtaatctactttctgaggaccggtagaaaccgccaggtttttaccctgtaatttcccctgcaaagcaactgcacgagcaagtaccccggtgtagtcggctccgcctttatcattccaacctgctgctcctacggtcaatgtgccttgacgcacatcaaatcctgtcagtgcaccgtctttgccgatttggggcgcaccggtagttaagatgccccgaccgacatttttaaagccgccgccattaacggtaatgccgttggggttggcaataatcacgtcggccttttgaccgcctacggtaacgatgccgttgagtttgctagccgtaccgcgtacctcgttcaaaatcaattgcgcactgcctttgaccacaaacggattattgttacggtcgttgtttaacactgcccctttgttgtcaacatcaaactgcgtatagcggttgtggctcaatccgcgtccattcggagtttggatattcaccaagggggcaccagtgttggttttaaggataacgacctgctggtttttaggtgctgatttgtcggtggtaatttgggcatgggcaggcaataccatactcagggaaaccaaagagcagaccaaagttttaagggtggttttgagtttgccgcaaaggtcgcctgaagttttcagtgaaacagaaaccgaactgcctgcctgtttacctttgccctggctgttggcagtttcggctactgcaaccatggtgctgtgctttttactaaagataatgcgatgtaaacctttattcatgtctattccattttgaagatgaacgtactgcgcgccaagtacgtaggtaaagtttgacggtctgaggataaggaaagaccgtctaaatatcagtaaaaaattcagaggttagaaactgtaattcaagttgaagccgtaaacggtgttggtcgtctgaaagcctttgggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttttcatcggcagctaaggttttaaggggtatgacagccaggataaccaacagacatggagcaggaaaaaatttcatgacatcaatattattttagcaatatttactattttgtcataaatttaaaagtatttacagttatagaatgagacctttgcaaaattccccaaaattcccaccaagacatttaggggattttggggaattttgcaaaggtctcggacagtattttgaacgcagtgcgcgtaaattcgtatggaaaccatgaaatcccgccacagccgccagacatgccaagccgcattctgatatttctgtttgcaggataacaggcagctttttctttaagcccaaagacaggttttgcagatggggcatagatttcctttttgaaaaatagggattaggaagttggatgtattttagaaaggccgcctgaaaaggtttcagacgaccttttgcgactagctgctattttatttaaagcttttctctaacaaacgagctaatatttttcctgtaataaaacagataaaaaacagcatccaatacgtcagattggaaaaatcggtcgtatagagaatcaacatataaagaagcagcatgatgccgagtgcgatgaattgataatgtttggcaaacatcatgacctcctcaactattaaggcaaaccgcctgaatattctcgttcaatcgtttcggcaatttccctataacgtcgataccatgaccagtcgaaattttcaatggcatggctcgcaaacgtaccaaattcaggcatccctatgcggctacctgctaaagctccgattgtagctccccaaccaggcggattactgaacgtattgtttggcaatcctaaagatttatcaggatttcccgtatcgttaagccctgcagattcgcaaatttcgcaataatatgagctttgttgcgcattacctgagcctccgacccaagtcatttcatgaacacatatagtggattaaatttaaatcaggacaaggcgacgaagccgcagacagtacaaatggtacggcaaggcgaggcaacgctgtactggtttaaatttaatccactataaaactctcattttgaaactccttgtatcgttaatcaaacaatcaaaagggcagatgccctatccttgcttttacaaacggagtgcctgtaaaaggggatggtttcaggcagttttgaagtttgtgtttttatatattgtcttctggtcgtctgaaaaggtttcagacaacttctttatctttacagcctcaagtcttacagtttgcccgacatactataaatcagctccaatacccattcgtacaatcaccgtttctcgtgtaggatgtctgcttccaacgtcatgccgatttgcagcggtttttcctcaccgtatgcagtgatggttgatttgtcgggttttattttcacaagataaacaggttcgttgctcttcgccaaatcggaggataccatgcccaatcccgacaattcctgtctgcccagtgccgtttttgctactgatacgacactgccggaagcaagcccgaatttttgatagggatatgcctgataacgtaggacaaccttgtctttcggcttgataaagcctgctgcactgctggggatatatagatgggcatatagctcggtacgttcgggaacaatgctcaagagcagtttggaaggatcaacctgctgtccgacttcgacgttcggtattgctatataacccgaccgtcctgcacggatgatttgttcagagcgcatttcaaaatccaaaacttcttgagaaatatcggcaatggtgcgttcaagccagctttgttctgtctcatgccgcttgggggaggctggccaatgtcagattctgcgtgcggatttcctgaagcagcccgacttcttctcggcggtaggcatcaagtttggctttctgctctaaaagctctgccttgacattcatcatttcttgttttggcactgcatcattggcggataggaaacgatatttctgcaacatttcttccgcaagtctaatgcgccttttctgaccgtctatctgttgcgaaatatggagttcctggttttccaaacgttcgacagttgctttaaggctgcgcgtttcattcccgtgtatcagcttcagacgacccagttcctgttctgccaacgttttcttcaaaactgcctccgttttcaactgctgctgcacgctacctcctgcgccgaaacgtgaggtcgaaagcgcaaatagcttgtcgccagccttaaccttttctccatcttccacgaatttcgctgtaattgtccccgtatccggtgcatacaccctgattacgcccgatgcaggtaaaatttgtccctccactgttgtctttcgcgtatagttaccaaatatcaaaaacaggataatcaataacgcagatatcgatgcaaatgtcgtccatagggaaaatgacaacggtcgtgtcagaatcactttacccgtcaggctggtttggcgggcaacggcgacttcgggacggaagaagggttgcttgggtctattcataaaattgaagttaagaaagtttcagacgacccctagagattgtctggacgatgagaaatatcagcagtaatctgtaccgtcagtgtagccgtttcctgatttatctgcttttgttgcgggagcagttaatccatgttcaatctcaaagattggtcttccgttataaggaggtgcattaacggcatcatttacccaattacgagtcacattgtatacaccatttgcaccagcagcaccgtaagcatttttcggcagataataaactgccgctgcggcagcaggtattgcaaccaaatccccccatgtgggacctcctttggttgtggcagcattagctacatttccagctatattgtctgttacaggacctccccctgaaaccagcttcaattcatgaagttgaagttcaatcatttttatactccttttcttggttggtattcctaaaaattcggctaacaaaaacatatggcagatatattgaaaaaaaattcaaagtaccctgaataaaattcaaattccaactatatttgttaatgtagtcgagaagaaacatatctgataaaaaatatagcacttgataacaagctattactaatattacgaaaaatgtaaattgcttccagtttttcatagaatccctcacaaaatttccagaaaatctaactctatcaactgataaatcaacttcctaacttcttcatattttccctgattgaagttaaccagtagatttttcaacaataacggttcattcttaccgatgtgttctaacacttttttccccaactcatctacgcttatcttcatcccattcccaatcaaatatcccttttccaacgtatccaaattattggcatttaatctcaacctgacgtcgtctgaaagcggagtagcgttgggattcgcgaactgttcgagatgaaaagcggtatcggtacgttctttgccgagaaagtcttcactgaaggcttcataattgacggggtcggcaatcatggcagcaatttgtgcggcagtatcgttgatacgcgtcctatcttgctcccagtctgagaaactgtggcgcagactttctatggtgggaaatttcttcattagccactcgaggtaattatagccgttgggtggaaaggtaccgacagcgaagtggaaggtttcacagccgagcgggataggtctgtgccaccaaccgcgtgggatgtagaggacatcacctgcttcaaggataatatccatatcgatatgttcaggaatggaaatatcagtatctttagtctgttgcatatacaatggcatagggaaatcaggggcagtaagttgccaacgtttcttgccgaaaagctggatggcatacacatcgcgggggtcccaatggtttttataagattcgtcgctgccaaaagcaagatatccactaacaatagtatgtgcgccggcaaagcgggcgacttgacgggcgatatggtctgaaaacggctcgttgttaatatggttatagactaacgacgcaccattcttcatatgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagtttttttttgtgtgtgcgtcaaggaattgttgacaattttagttaaaaatttgtctccaaacggaaaaaagcggtttgttttttgttgttaacatttttattgtaattaaataaaaggtcgtctgaaaacggttttcagacgaccttttgctataatcgggcttcatcgccccgttcggtttggaaccttatgaaaaccctcgtcctcctcctgctttccttctccacgaccaccgctttcgccgcatacggtttgggtttggggcaggcaccgaaatatcctgccggctttcgcgcctacggttatgtttattccggacggcagggctaggttttaaaaacagaggcggatgccattaaattagacacgcttttcaaacgctttgtgtaccgtccttccgccgccaatcaaaaccccgtcggacagcgttcggacggcatacccgccaaccacacaaaggaaaaaccatgagtaaaaaaatcaaagtcggcattgtcggcgcgacgggctacaccggcgtggaactgctgcgcctgcttgccgcccatcccgatgtcgaagtcgccgccgtaaccagccgcagcgaagcgggaaccgcagttgccgattactttccgagtttgcgcggcgtgtacggcctcgccttccaaacgcccgacgaggcaggtttggaacaatgcgacatcgtcttcttcgccacgcccaacggcatcgccatgaaagacgcgccgcgcctgattgaacagggcgtgcgcgtcatcgacctttccgccgacttccgcatacgggacattccgacctgggaacactggtacggcatgacccacgccgcccccgacctcgtttcccaagccgtgtacggattgagcgaactcaaccgcgaagccgtcgcacaggcgcgcctcgtcgccaaccccggctgctacccgacctgcgtatccctaccgctcgtgccgctgttgcggcaatgccgtctgaagcccggtatgccgctgattgccgactgcaaatccggtgtgtccggcgcgggcaggaaaggcaatgtcggttcgctgttgtgcgaagccggcgacaacttcaaagcctacggcatagccggacaccgccacctgcccgaaatcaggcagaccatcgccgggcttcaggacggcatcgccgaaggattcgtgttcacgccgcacctcgcgccaatgatacgcggtatgcacgccaccgtttacctccacctttcagacggcagcgaccccgaaaccgtcctgcgcgactactaccgcgacagcccgttcgtggacatcctgccgaccggttccgcccccgaaacccgcagcgtgcgcggcgcaaacctctgccgcatcagcatccaacaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccctgaagcgcaaacagcaaaccgcaggcatcgtgcctgcggtttttgatgccgtctgaaagcgacgtttttttgggttcggacggcttttgacccatccattcacacgaaaacaaaaatctaaaataccgtcattcccgcaaaagcgggaatctagtttatccagcttcagcaatttccgacacatttccacacgcttcgattccgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccatcattgccgcgaaaacaaaccaaaaacctaaaatcccgtcattcccgcaaaagcgggaatctagtttatccggcttcagcgatttccgacacatttccgtacgcttcaatttcgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccgtcattcccgcaaaagcgggaatctagtttatccggcttcagcgatttccgacacatttccgcacgcttcaatttcgtcatttctccggtttcagtcattgccgataacaccgtggttttttatttctagattcccgcctgcgcgggaatgacggcggagggcttgccgtttttcctggtaagtctctgcggcttctcattgccggtttccgcctacttgggaatgacgtgatttaaaatcatgaaaatgtgtcaaaaataatatagtggattaacaaaaaccagtacggcgttgcctcgccttgtcgtactatctgtactgtctgcggcttcgtcgccttgtcctgatttttgttaatccactataaaaatcagatttccgttacacttttttccaatatttcagacggcattttgctcacacgcccaaatacccttccctgccggaaagccaccttgccaaatgcgcttcgacgatttcggggttttgttcaatcagcatcggggcggtttcgcgcgcttgttccaagaggtgcaggtcttcttcgagcttggcgaaacgcagcataggcacgccgctttggcgcgcgccgagaaattcgccggggccgcggatgttgaggtcttggcgggcgatttcaaagccgtcggtgtgttcgtagatgactttcagccgcgctttggcgagttcgcccaagggttcggcaaacaggaggacgcacacgctttctgccgcgccgcgcccgacccgaccgcgtaattggtgcagctgcgccaagcccatgcgctcggcgtgttcgatgaccatcagggcggcattgggcacatctacgccgacttcgatgacggtggtggcgaccaagacgttcagcccccccgaagaaaaccgcgccatcacttcggccttttcggcggccttcatgcgcccgtgtaccagtccgatattgagttcgggcaatgccgtctgaagccgggcgagggtttcggcggcggtttgcagttgcagggtttcgctttcttcaatcaatgggcagacccaatacgcctgccgcccttttcggcaagtgccgaggacgaagccttcgacttcggcgcggcggacgttgttgacgaggcgcgttttaatcggtgtgcgcccgggcggcaattcgtcgatgacggacacgtccaaatcggcgaaaaaactcatcgcaagcgtgcgcgggatgggcgtggcggacatcatcagctgatggacttcgcgccctttgtttttgagggcgaggcgttgggcaacgccgaaacggtgctgttcgtccacaatggtcaagcccaaattgtgaaacgccacgccgtctgaaaacagggcgtgcgtgccgacggcgattttgacgctgccgtcggcgagtttggctttggcttcgtctttggcttttttacgcaaactgccaaaaaggcggacaacttcaatgcccaaaggttcgagccattgtttaaatttaataaaatgttgttcggcaaggatttcagtgggcgccattacagccacctgcgcaccggattcgatagccgtcaaagcagacaaagcagccacaatggttttgccgctgccgacatcgccctgcagcaggcggtgcatcgggtaggtttgcgccatatcgcggcagatttcggaaacaactttttcttgcgcatcggtcagggcaaacggcagggcttggcgcagggcttgggtcaatgtgccgtcgccgcccaatgccgccgccgtgccgccgatacgcttctgtcgcgccaagcgcatcgaaagctgttgcgccaaaagttcatcgaatttgagccgttgccatgcaggcagcgtgccgtctgaaagctgatgaatcgtgaaactcggcggcggcgaatgcaaaagacgcaggctttcggcgaggtgtggcagcttcagacggcacagcagggcatcgggcagcgtgtcgtgcagcggcgtaacgtccaacgccgtctgaataatacggcgcaaagtgggctggttcaaaccgtttacggtcgggtaaaccggcgtgaggctttccgccaaaccgccgccctcggcatcgcggattttgggatgaatcatctcgtcgccgtaaaagccgtgtttgatttcgcccacggcgcggatgcgtttgccgaccgccgtctgtttctgatggctggcgtaaaagtggatgaagcgcagaaaaaggacgctgccggagccgtcggcgatttggacaatcagctgcttgcgcggtttgaacgttacttcctgatggataacctccccctcgacctgacacggcacgccaatcggcgcgtccttaatcggcataatgtgcgtctcgtcctcgtaacgcagcggcaggtgcaacaccaaatcccacgcggtatggaggttgagtttgtcgagcttcttggcggaaacatcggtgattttgagctgttttcgggtttcgggcgacatcataggcagattcctttggacgcgcctattttatccgaaaacaaaaatgccgtctgaaacggattcagacggcatcgacaggcaggaatcaagccccggcggcttcggcttcctgctgttgttggtaaatcgcctcaaaattaatcggcgcgagcaggacgggcgggaagccggcgcgcgttaccgtaccggaaacggcttcgcgcgcgtaagggaagaggatgttcggacacgccacgccgagcagcaggtcggcatcttcttcggggatgttttccaaacggaaaataccgctttgggttacttcgttcaaaaacatcgtgcgctcgttatccaatttggcggttacggtaacggttacatccacgttgtagtagccgtcttccagcttttggctgccggtggaaacgcgcatctccacttcgggctcgccctgttccaaaaagatttgcggcgcgtgcggcacttccaaagacaagtctttgacatacagtcgctcgatgctgaatacgggttgcagttcttcgctcattttgttttcctagttgggggttaagggttcagcagtccgtccagcccgccttcctgctggaggcggtagaggtcggtaaatccgccgacgtgcgtttcgccgatgaaaatctgcggcacgctgcgctgtcccgaaagctgctgcatttcggcaaaggcttcggggcttgcatcgacacggatttcgtcgatatgtccgacacctgccgcgtgcagcagccttttcgccatcgcgcagtaggggcaaaacggacctgtgtacatggtaacggtctgcatattgggtttccgaaagttttgcaatgataatcaatataggggcatttcccctgtttggcaagtgcggaacagatgcacgttcaaacggcatgtgcggaatgtgtcaaagtttcttttttaaagtatgatagacattgtgaaaaatatttttgcacccgcgctgcgcggcggaacggatgcaaaatatttttattacattttcaggaaaaaccatgttgtcaggactccccatccccaaagacatcgcgcgcccgcccgaaacgatattggtcaacatcacgccgcagaaacgcgcgtagcggtgttggaggaaaacaatatctgcgagctgcacatcgagcgcaacagcgaacacagcctagtcggcaatatctatttgggcgtggtgcgccgcgtgctgcctgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtctgttttggtgcaggtcatcaaagacccgatcaacaccaaaggcgcgcggctttccacccaaatctcgctggcggggcgtttcctcgtccatcttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgcccgaaaccctgctttatcaggatttgcctttaagcctgcgcgtgttgcgcgatatggtcggctgcgacacgcaaaaaatcctcgtcgattccaccgtaaaccacgggcgcatgacgcgttttgccgaacaatacgtccacggcgcattgggcaggatagagctgttcaaaggcgaacgcccgctgtttgaaacccacaacgtcgaacaggaaatcagccgcgccctgcaaccgcgcgtcaacctcaacttcggcagctacctgattatcgaatccaccgaagccatgaccacgatagacgtgaacaccggcggcttcgtcggcgcacgcaacttcgacgaaaccatcttccgcaccaacctcgaagcctgccacaccatcgcccgcgaattgaggctacgcaacctcggcggcatcatcatcatcgacttcatcgatatggcacaggaaagccaccgcgaagccgtgttgcaggagcttgccaaagccctcgccttcgaccgtacccgcgttaccctgcacggttttaccagcctagggctggtcgagctgacgcgcaaacgctcgcgcgaaaacttaaaccaagtcctctgcgaaccctgcccttcctgccaaggcagaggccgtctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctctggcggtcgaaaccgcttacacgcaggaacaatacgacatcgttttgatgtaaaaaatgccgtctgaagccttcagacggcatctgtctatttcagggtttccttgtccaacaacgcgcgtatcagcagaccgcgtccgaaacgtcggctgtcggacaattccaaatatccgccgtattttttggcaagcgtgtcggcgatggacagacccagccccgtcccctgctgctccgttcccaaaatacggtaaaacggatcgaggacacgggcgcgttcggattcgggaatgcctttcccgttatcttccacccacacggcaagatatttcccttcgtccgtgaaacccaaatctatcctgccttcgggcggcgtataacgtaccgcgttgtcggcaaaggttttaatcagcgtatagatttccgtttcgtcggcagacacttcgacatcgcctccgaccgccacgccgatgtcctgacatttttccaaagccagcggcatcagttcctgcaacacttggcggaaacggctttgcagaccgaatgtcgttttcgtcagagggatttcatccgactgcgaacgcgccaatgccaaaagctgttcgagcaggtgtttgttacgccgtatgctttgctgcaaaacggcaggctgccgcgccgcatcgggtgggagcggcatattgttgagccgttccgcctgaaggggaagggcggtcatcggcgtacgcaattcgtgtgccgcgtcggcgacaaaccgctgacggtggcggatgtcttcatccgcacgtttcaaaagcaggttgatggcggttacgaaacctctgatttcactgggaatattgtccacactcaaagcagacaggtcattgattcggcgttgttcgagactttgcgacaatttgcggacggggcgcatggctttgtgcgtaatccacacggtcagcaaaatcatcagcggcagtgccgccaacaggggcaacacgctttgccgtgccgcatccgccgccaaatcttcacggtattcgttttcctgcataacggcaatccgtccctgctcggtcgtgcggatatagacgcggtaataatcgtcgtcatcgtccgcctgaagcgtgtgcagaccgtccgccagatgcgcaggcaggctgacaacagggtcttcctgctgcggcatctgtaccaaaatacgcgtatcgccgtcgccctcgggcaaagtttcgggtttggaatcgggggcgacgtacaatgccgcctgacggagcaggtcgtcctgcaacgcttccgtttcgtggaaggtttcgtagtaggaaaacatacctgcaagcattgccagcggaacaaacatccaaaccgtcccgccccggcaaacccaaatccagcagcatcaagtcataaggctgggcagcggcagccgcgcgccgtttttgacccaatccaccgcatagccgccgtctttcaaacttgccgacaccgcctccgcaatcatcgcatcgtcttccaccagcaaaacacgcatcaactttcccttcaaaataaaccgtgcctattctaacaccccaaaattagccgcaatttagcggtctttacgcttgccggtatttttcaaaactgcagcacaaaaaaaccgcgccggcaactgccttcagacggcattggggcgcgattgcaacacacgggcaggcaggcagagcctgcgacagaccacaggaacgattcaggcttcagacggcttcgccgtttacggcagaggcacgattcctgccgctatcgaactggccaatatcgccagcgacaaaccccacgcccagaaaaacgaataacggatgtgtttgcccatcgacaatttcgccaaacccaagcccatccacaaagccggcgaaagcggcgtaacaaaagtgccgacgatactgccgatcaacatcgcataacctgctgcttcgggcgccacgcccgcctgcgaggtaatctgctccacaatcggaaacagtccgaaataataagcgtccgtactcaaaaccaactcaagcggaatgcccaacacaccgatggcaatatgcagataaggcagcagcgcgtccggcaggatatgcacaatgtctttggaaatcgcgtccaacatccccgcacccttcaaaatccccaaaaacgtacctgccgccaaaataatggacgccatcatcaccgcgccgccggcgtgggcataaatccgctccatctgttcctgcgggctgcggtaattcaaaagcaacgccgccgttgcagccagcataaatacataacccggtgggaagatgcccgaaaaaagcaggctcatcgccgccaaaaacagcaggacattccaccaaaacagtttcggacgcgccaatttttgttcttcttccgacaaaggcaccggctttatcaaatccgccacggcgggcaacgcgcccaactcccggacaatccgccttttttcacgcacacccaaaagcagggacagcgcaaggataaacaccacaccgataatttgcaccgtcaacaaaggtttatacaattcgcccacatctgcgcccaacacgcttgcaacccgcccggtcggcccgccccacggcagaaggttaatcaatcccgcactggaagtcagcagcaaaaacagcaggtaaggattcatatgcagacgcttgtaaagcggcaaaagggcggggacgaccaataaaaacgtcgtcgcacccgccccgtccaactgcgccaccaccgacaccaagaccgtccccacactcactgccacgatattaccccgagtcagcttaatcaaaccgcctatcatcggacggaacagccccacatcgttcatgattccaaaaaacaaaatggaaaacataaacataatcacaatctgcatcaccgatttggtgccgcccgaataaaattcttttaattgggatacatcaaaccccgccagcaacgccccaaacagcggcaccaagattaatgcgatgatgggcgacactttttccgtcagcagcagccatacgatgaccccgataatcagcagtccgataaacgtcagcatcatttctcctttattttattttaaacagaaaaccgaccgtgcaggcaaaaccgcccacagacgcgggataagccctgcattctacttttttattttgaaacaagtcaatcggtcatttcctcccatttacgcctgccgccattcctgcatccgtccgtcatttcacagcggcaaccgatacggaacaaccggtaaatcggtatcgggacggcgcgggggcattcatcccggtgcgccgattcaaacgaaaccgcccctatcattgcggagcgcggggcgtgccgtacacgcgggattttatagtggatgaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccgctataaacacgccggtcatttgccgcgcattatccggcaaacggcaaaccttgacgctgcccagcccatataaaaaagccgcaaaacccgaaccggttttgcggcctttcgacttggtttgtttatttggcatttctttcaatcaaaccgacaaactgattaatatatgactgaacaaaatcccttgccgagtcaatcaatttgccgttttcatcaaacagcgtcggcgaattgcccaaaaacacttccggctgtccggttacgggcatatcgaaataagacagcgcaaggcgcaggtttttttgggaactgtaaccgcccatcttgccgacggaatggctgatgatgcctgccggtttgtttttccacgccacgtcggcattcggtttcgagccgatgtccaccgcatttttcaaacaggcgggaatggtgcggttattttcggacgtaacgaacaaaatgccgtccgaagccttaatcgtttcgcggaaagccgtgtagctttcgggtagcggcacatcttccaccgcagggtcgtcataatcgaaattgtaaagcggcagatgtccgatttcaacgatttccgcctgccagccttcggggaacatctccgccgcattcaatgccactttgcgcgcaaaagaagcacggcgcaggctgcccaccaaaatactgattttcttagccataatcattcctcctgaatattaagtttgtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctgaaacaggaaaatatagtggattaaatttaaggggctgtcctagataactaggacaaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctgattccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaacaatactgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgcgacaaacagttcaatgagtttattttgtttataccggcttagacgactttttctcataggggcaactctaacttaatttgaatttccctagttatctaggacagccccaaatttaaaccagtacggcgttgcctcaccttagctcaaagagaacgattctctaaggtgctgaagcaccaagtgaatcggttccgtactatctgtactgtctgcggcttcgtcgccttgtcctgatttttgttaatccactatataaaaatgccgtctgaactgttcagacggcatttttgattttcaaaccggaattacagccccgctgccgccctcaatgcagcagctttgtcggtgcgctcccaagtgaactcaggttcttcgcggccgaaatgtccgtaagcggcggatttactgtaaatcgggcgcaagagatcgagcatttggacgatgcctttggggcgcaggtcgaaatgttcgcgaactaaggcaatcagtttttcttcgctgattttgccggtgccgaaagtatcgatggaaatcgaagtcggttcggcaacgccgatggcgtaggaaacttggatttggcattgggttgccaaacctgcggcgacgatgttttttgcgacatagcggcaggcgtaagcggcggaacggtccactttggacgggtctttgccggagaatgcgccgccgccgtgcggagccgcgccgccgtaggtatcgacgatgattttacggccggtcaaaccgcagtcgccttgcgggccgccgataacgaagcggccggtcgggttgatcaggtatttggtttcgtcggtcagcagttcagacggcagaaccggtttgatgatgtgttcgattacggcgtttttcagctcttcgtaagcgatggacggatcgtgctgggtagacaggacgacggtgtcgatgcgttttactttgccggtttcgctgtcgtaaaccacggtcagttgggctttggcatcaggacgcagccaaggcaggcggccgtctttgcgcaattcgctttgacgctgcatcaggcggtggctgtaatagatggcaaacggcatcagggtaggggtttcgtcacaggcatagccgaacatcaaaccttggtcgcccgcgccctggttcaagtcgatgccttcgccttcgttcacgccttgggcgatgtcgggggattgctggtcgtagtacacgccgactgcgcagccgttggcatcaaagcccagctcggaggagttgtagccgatgcgtttgatggtttcgcgtgcgactttgatgtagtctacttgggcggtggtggtaatttcgcctgccaatacgcacaagcctgtgttgaccaaggtttctgcggcgacacgtgcttttgggtcttgcgccaagatggcatccaaaatcgcatcggatacttggtcggcaactttatccggatggccttcggataccgattcggaagtaaacagatattcgctcattgagattttccttgaaaaacaaaccatcttcttcagacggcatgttgtatgaacataatgtcgacagcgggaaatatagcaaaatttccctattcataccattcagttgagaaatattcccatttgaatagcactttggaatctctgcccgtacgtttcttacaggcaaaaaaattcccgcatcaagcgggtttggattgctctggtgagccacatcggcttttcaaccgtccaccttacttttccttttgaaaagcaggttggcatggaattcccaactcttaatgcagcacgcatcgtagcagaaaaggcatattgccgcaatacttccctttttcagacggcatgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaacgaaaataaaaatgccgtctgaacaatttcagacggcattttgtcatctgacgatttccgacagcggccagcgcggacggacattgaacgcaccgacctccctgcccttgcccaggtgcatcgcaccggcaaaggcaatcatggcaccgttgtccgtgcagtatgccgtcggcgggaaaaacacgctgactttttcggacggatgtttcggcttgcctttgggggtcgggatttgcaccgtcatgttgccgaaagtttcacggagcttgcggtttgcaccgaccccgccggcgaccactacggttctgaaccctgtctgcaacagggcttttttcactttcgccgccaacacatcgactaccgcatcttgaaacgcacggcagatgtcgttgcgtgtctgctcaggaatgtcatccgccccgttttccgcgcgcactttctcgacggcggtcaatacggcggttttcaaacctgaaaaactcatctgcaaatcgtcggaatgaatcatcgggcgcggaaaaacaaacgcttcgaacctgcccgattccgcaagttccgacagtttcgcaccgcccggatacagcaagcccagcagtttcgccgttttgtcgaatgcctcgcccgccgcatcatcgacgctctcgcccaaaagcgcgtagtcgcctatgcccctgaccgccataatctgcgtatgcccgcccgaaaccaacagcgcgacaaaaggaaagtcgggtttttcctccgccaacagcggcgacagcagatgtccttccaaatgatggacgggaataacaggcttgtccaacgctaaagccagcgcgttggcgtagctcgaacccgccagcagcgcgccgcccaaaccgggcccctgcgtaaaggcaaccgcgtcaatgtcgccatacgatgcgcctgcctgcgccagacagccttccgtcaacggaacaaggcggcggatatggtcgcggcttgccaattccggcacaaccccgccgtattcggcgtgcattgccatttgagtgtgcaggcagtgcgcccgcaatccacgttccgtatcgtaaagcgcaacacctgtttcgtcgcaagaagactcgattcctaataccaacatggtctgatgccgttaaaaactgaaaaacgtattttagcggatttcggcacgactgccgtatcccaaaaacggaacatgccgtctgaagaccgttcagacggcatcgtcgcaccgtatcaaagcgttccgtaagaatgcagcccgctcaaaaacatattcacgccgataaaggcaaatgcggttacgaacaaaccgataatcgcccaccacgccagcactttgccgcgccaaccggcaaccagccgcaagtgcagccaaacggcgtaattgagccagacgatgaacgcccacgtctctttcggatcccaactccaatagcgtccccaagcatctgccgcccacagcgcacccaaaatggtggcaatggtaaagaacagaaagccgacggcaatcgccttatacatcacctcgtcgatcaatgccgacggcggcagccacagttttccgccttttccttccgcacgcagggaaaccagttcggcaataccgagcatcgcggaaatgcaaaacgcgccgtaaccgataaagtttgccggaacgtggattttcatccaccaggactggagcgcgggaatcagcggctggatggtatgcgcctcgcgggacacgctgtaccacaagacaaatccaaccacgaccgccataaagccgaacacgaagccgcccaatttctgtatggcgaacttaccttcataataaagatacatcagcgcggtaatcaccaaaaacaggatgaacacttcatacaggttggaaaccggaatatgccccgcatcgggacggagcagatagctttcgtgccaacgtaccagcagaccggtaaagcctgctacggcagacacccatgcaaacacggttcccatacccaacagcgtgttggtcggcacattttttacgcttgccaaaaccgcgcccgaaatataggcgaacagggcgaaaaagacaaaggcgcactgccacatgatcgccgactggctgctgaggaaataccgcaacaggaaaatctctgccgatttgatgtcgcctccgtacaaaccgacggcggcataggcaagcaatacgcttaaaggaacaaaccagcgcatcggtttgaaaaaccaacccaaaaacacggcaataccggcacttgcccacaacatgaccgtttcgtaaatgtccatatgcataccggaacgggtctgtacgaaaaccgtagccgcaaaaaccagcacggcaaatacccaatcccaaagattcagattgctgatcaaagacttctgaatcagcagctcgtgttccggaagggttttatagtgttcagtcatgattcaagtccttgccgagccgttgcagactctcgacgtgttttggaaattccttctgcaaatcccgttcgctgcgggccgaagacatggcaaaacggattttgccgtctgaaaacaatacccacgcccgtttttcgcgcacataaaacatcaataccgtacccaataccaacagcaccgagccgagatagaccaaaagcgcacccggggaacgggtcatctgcaaacccgacgaacgcacctcggaaaacccatcaagttgcagcagcataggcgcgggatattcggtcaaacccgtgtacgcatccatactgtgcagcaggaaacgattccgcgcttcatcctgctgccattcgggcaagccgtaccggcgtatggtttcatccaaagcagcgttcatcacgccgtaaagcatttcgtagaaatagccctgcatcttatcctgctgctctttcgggatattggacgtaataaattcgtccaatcccaaatagcctttttgtgcaaagatgttcagcgtgttttccgcagccagcatgaattgttcgcggatttcggcaggtgcgcctttggttgcgtcggcaaccagacgtttgcgcccttccccatctttcaaaaactcacgcaatgccataaaggtgtccgctttcaactgcttgtccaaggggatacgcagccagcggtattgctgctgcaagccgctgcgcgtgccggtaatccaaaaataatcctgttcctgcaaaaccggcagcatatagtttttatattcgaccgcctgccctgccgcatcacggatacggtaaacaatggaagggccgatattggtgtattttttaccttcctgagtaacggcgcggacatcgttcagcgtggatttcaggcttttttcccgttccgcgccctcgctcatgtcctccacattcatagaagtgaactgatcgaactcaagacgatatttgtgtttgccaatttccaacggaaactggtgtatggatgttgccttcaacacgacaggctcgcgcgaagcatcacccaaattccacgccttgaatgtcaaatccgaaccgccgtcggcaaaactcgcctgataaatcgtgatgccgtgcaaggtcaaaggatggttcacgcggatggtgcgctcgagtttctcaccggttgccttgtccgtcacttcaatatcgctggcgaaatcacgcggcatacccgtattgtaaaaatcgatatggaattttttcagtttgacttcaaaaggcaagtcctgaaccaatatcccgttgtcggcattcaggaaaaccacatccgcactctgcccctcggaaatattgacgttgcccctaaatgagagattggacgcacccaaaatactttcgggcttgaaatccttggcataaaccgcctgattgtccggaacaatccgaccggtcagcatacccagtttcaacagcaggttactgtctatcaacccgcccaggcaaatgacaatcaaagcaacatgggcaaagatatagccccatttgttcattgtgccttttttggcggcaatcagaaccgacccgtcttcacggttaatggtttttccctgaaaaccttgtacttccagataacgtttggcaacctcgggcgcaatttttacatccaacagcgaagaatggcgcatcgccgccagagatttttctttaaccttttcccgaaaagacttcatttcgcgccagaacggcggcacattgcgaatcaggcacaaactggtagaaaccaccaaaaacatcatgataacgacaaaccatgccgaagcatagacgtcatacagtcccagaaaaccaaaaatctgcgcccaaaacgatccgaatttgaccaaataatccgtctgcggctggttttgctgcaacaccgtaccgataaccgatgcaatacccagcagactgagcaaagcgactgcaaagcgcatggagctgaaaaaagcgaaccacggacgggaaagaagtgggggagatctacgggatttactcattgtgtgtttattccgccatcaggaatatgggaaagcagaattgggcaaacagaaaacaacgtcccgattctactgtcttgatgctttttatttcaagacaatgaagacagcctgcatcgattccaacggttgcgattgaaaaaacttatcgcagaattgcctgaagccgtctgaaaacttttcagacggcctctaaaacagactattgcggaattaacgcaaaccttggataaagttggcgaccgctttcaaatcttcttcagacatacggtttgcaatatcttccatgatggtatttttacgctgaccggacttgtaggcattcatctgttcaacaatatatgcctgatgctgaccgcccaaacgcggataagcctgaatttcgcttccgcctcccggcatacccgcaccgctcggaccgtggcaggacatacacgccggcacttttttatcgctcaaaccgccgcgatagattttcgcacccaattcgggattttccttaggattggcttcaccggatttgggctgctgtttggcatagaatgcggatacgttcaaaatatcctgatcgctcaaattcattaccaccggtttcatcacagctgccgaaccgtgggtgcgtttaccgtcgcggatgccgatagtttgatgatagatgtaagcagtatgctgtgccgccaaacgcggatacatcgcaatgccgctgttaccgtctgctgcatggcaagccgcacaaaccgttgcggcaacctgtttgcctttttccacgtctgctttgggagaggcggaaaccgcaccggcagccaaaacaaaggccaataaagtcaatcgtttcatggagtgctcctgattacagcattggataacgcaacaatgctctttttatattcaaatacgggatttttgacccgattaaaaccgatgattctgtaaacgtgttattctatactaaatttacattaaattaccactgtgtttcacataaaaccaaccgcatatttttgctgtcggacaaacggcggcggaaaacaaggatatgcccatgaacctttttcaaaacgccaaattcttcacgacgatcaaccaccttaaagacctgcccgacacccctctcgaaattgcctttgtcggcaggagcaatgccggaaaatccagtgccatcaataccctgaccaaccatgtccgtcttgcctacgtttcaaaaacacccggacggacgcagcatatcaacttcttcgagctgcagaacggcaattttatggtcgatttgcccggctacggttatgcccaagtccccgaagcagtacgcgcacattgggtcaatctgctcggcgactatctgcaacagcgcaaacagcttatcgggctggttttgattatggatgcccgccatcctttaaaagaactcgacatccgtatgctggattttttccacacgaccggcagaccggttcacatcctgctgtcaaaagccgacaaattatccaaaaacgaacagataaaaaccctgtcccaagtcaaaaaactgctcaaaccttattccgacaggcaaaacatcagcgtacagctgttttccagcctgaaaaaacaaggtattgacgaggccaaccgaactgtcggaagctggttggacgcagcagatgccgccgcttcctctccagaggaaaactgaccccaattatacggaaaccgtattccccccacttgaccgaccgcaaacatttaaaaaattgccactgccaaatctaaaatgccgtctgaaaagtctttcagacggcattttgcggagtctttaaaacagagaatccaactgctgctgtttggaaccagtattactcggaagcaccggcgtttcctgcatatcttggcggacttcgtcatccgccgcctgccgtccgccttctgccgcgcccccgtcatcttcttttgcccgtcgggaaggttgcggcgcaataccgctgttgtccagcgtcaagcccggatcggttaccatacgttccttcatatagtattcgccattgctgctgaccacaccttcaggcattttcatccccttgccctgctttcctttcaacgcaaaacgcatatagtccacccaaaccggcaccgcaatcgtaccgccgtagccgacacgccccatactcttaggtttgtcgaagccgatatatacggcagtaaccacatcagggttaaaaccgacaaaccacgcatccttattgtcattggtcgtacccgttttaccggcaatatccgttcttcccaacgcagctgccccccttgccgtaccaacacggaccacatcctgcataatcttatacataatataggcattgcgcggatcgattgcctgaggcgcattttgcccagccaccaaaggttgcatttgggcgcgcaacctgccgtctctgtcataaatcttatcgattacgtgcgaagaaaccctatatccgccgttcgcaaatacgctatatgcctccgccactttcaacggcgttgtctcgcccgtacctaaagccatagacaggcttgccggcagctcggacgacctgaagccgaaacgccggatatactgttgcgcgtaaccgacaccgatagacatcaaaatacggatggaaaccatattcttggaagccgtcagagcctgtctcaaagtaatgtagccggaatatctgccgtctgaatttttaggtgtccaaaccgaaccgttcggccctttccccggcagggaaatcggcgcatcgttaaccactgtggacgcggtcatccccttagataatgccgccgaatagacaaacggcttaaaggtcgaacccggctgccgcattgcctgaacggcacgattgaatgttttgctgtgaaaatcataaccgccgaccagcgcgcgcacagctccggtttttgcatccagcgaaaccaaagccccctgcagcaacggctcttgaaccaccgcccaacgcccgccgttgtttttgacacggatgaccgcgcccctgcggatacggtcctcccccattttttcattattgaccgcgcgggccgcaaaacccaaggcgcgcctgtcaagcgtaacccgcctgccgccgggcagctgtatgacgacatttttctttttagtcacatccaacacaacggcgggaaccattttatcgacggtatagagtcccgacagatactggctgacagtctcctcgacatcttcactcttactcaaatcgatatagttttccgcaccgcggtagctgctgccgcgatcgaaattccgtagagccttgcgcaatgcctcggttgccaccttctgatgatcggcgcggaccgtggtataaaccttaaaaccctgcgtataggcatcttcaccgtatttctcatacagttcctgacgcaccatttccgccacatataacgcactctgatcgattttccgaacaaaccgctcgtaatgcagttcctcattcaacgcctgatcgcgctgttgcacggtaatcatcttctcctcgagcatattgttcaaaatatacttctggcgcaacttggcacgttctggattaacaatcggattataggcagacggagccttgggcagtcccgcaagcatggcggcttccgccaaagtcaaatctcggacattcttattgaaatagatttgcgcggcagatgcaaaaccataggcgcgctgaccgaggtaaatctgattgaaatacaactcgaggattttgtctttgcttaaagactgctcgattttataggcaagcaacacctcattgaatttgcgtgtgaacgttttttcactgctcaaataaaaatttttcgccacctgctgcgtaatcgtactcgcacccgactgcacgctgccggacacgacattgccgacggcagcgcgggcaacaccccaaacatccaccccccaatgccggtaaaagcgtttatcctcggcggcgataaccgcattccgcaacacctctgggaaatcgccgatttttgtaaattcgcgccgctgctccccatacataccgatgacttccccatccgccgaataaatagtcaacggcattttaggctggtaatgctgcaaagaatccaaagacggcagtttcggatacgttaccaaaatagcaatggcaaccaaacccactccaaatacacaaaacccaaaaaccaaaccaaaacaagtcgttaaaatctttttaatcatagctgaataataatttaccattattggtattaaataaagtaaaatagcaaccgatttctacaaagcacggtttcaatgtgcaaagaacaaggaatccattacggataccgaaacggttactcactgtacaaataaagcaggaactttcatcatgcgcttgtttaaaagcttgaaaaaccctaaaaaaacagatgccaagctccctaaaaaatcttcgggactcaataaccgcgcggcaatcggcatcgatatcgaccagcattccatcaaaatggtccaattgtcaggacgtagtttaaaccaaattcaattggaaaaatacgtcattgccaaattaccaaagaatatcattcaaggcaataaagtccaaaattacgatcaacttgttacatatttgcaacaagcctatgccaaactgggtacttcgtgcaaaaacatcatcgcgtccgtcccgcaaaatttggcaaccatcgaacaattgacctacacagacaaagatgcagaattagacctgcaggggttcgtggagtcctccatctccgaagtcagctcgatatcgctcgaagaagccaattacgactatcaggtcttgtcccaatcggccgccggcgaagctgtgttggccgtcgcatcgagaaaggatgaaatcgaacccctgattgacgcattcaacgccgccggtatgaaattatccgcgcttgatgtggacattttcggacaatacaacgcctacgcgctatggataaaccatttcgcccccgagcttgcagccgaaaaagtcgccattttcggcgtatatgccgcacagacctacgccttggtcatccaagacggaaaaatcctatacaaacaggaaacctccgtcagcgaagaacagctcaaccaactcatccagcgcacctatcaggtaacagaagaaaaagcggaagaaatcatcaactccccgcaaaaaccttccgattaccaagaaagcgtggcaaactatttcaaccagcagattacccaagaaatacaaagggtcttgcagttttattacaccacgcagaccgcagacgatatgaccgacatcaagcatatcctgctgaccggggaagcggcgcgccaggaaggcatcgcccaaaccgtcgcctcacaaaccaatgcagatgtacaatgcgtccatcccgcgcgttattttgcggacaacctcaaaacagacaaacaacaattcgaacttgatgcgccgacactgaccagggcgttcggtttggcggtacggggattataattatgaacaatttaatcaaaatcaacctcctcccctacagggaagagatgaacaagcgcaaacagcagcagtttaaaacgctgatgtacggtgccgtgctgacgggcgttgccgccgttgcggcaacctacctgtttatcgacaatatgatcaataaccagtcggaaagaaacacgctgctggaaacctccatcgcacacttggataccgagctgtcggaaatacaaaagctcaaacaggaaaaagatgccttcctgattaagaaaaacaaaatcgaggagctccagctcaaacgcctccaagccgcaaaaatcctcgacagcctgaatgaggccgtccccggaagcacctacctgacctcgctggatgccgttaccgccgactcttatcggctcagcggcaggacatccagcgacaaccgcgttgccgccatgatgagggcgatgcccaataccggcatattcaagcaacccgaattgttaagcatcaagaaaaacaattcgcatcaagaatttacccttcaggcaacattacaacccatcgtaaaggcggccgaatccaaagagaatccggcttcgggaaacgcacaggaggcaaactgaatggcttctaaatcatctaaaaccaacttggatctcaacaaccttcacctgctcaaccttcctgccaggctttttatcgccctgctggccgttgccgccgtgctggggctcggttatgccggattgttcaaaagccagatggaatcccttgaggaatacgaagcaaaagaaaccgaactgaaaaacacctacaaacagaaaagtatcgacgcggccagcctgaacaacctgagggacgaacttgcctcaatccgctctgccttcgatatcatgttgaaacagctgccgacagatgcagaaattcccaatctggttcaagagcttcatcaggcaggttcgagcaacggtctgcgcttggacagcgttatgccccaacctcccgtagatgacggccccatcaaaagattaccctattccatttccattaccggaaattacgaacagatcagccaatttacccgcgatgtcggcagcctctcccgaatcattacccttgagtcgctgaaaatcgcccaatctccggaaaacggcggcaatcctgacggcaagagcagcatcctgaacctcagcgccattgccaccacctaccaagcaaaatccgtagaagagcttgccgcagaagcggcacaaaatgccgagcaaaaataacttacgttagggaaaccatgaaacactatgccttactcatcagctttctggctctctccgcgtgttcccaaggttctgaggacctaaacgaatggatggcacaaacgcgacgcgaagccaaagcagaaatcatacctttccaagcacctaccctgccggttgcgccggtatacagcccgccgcagcttacagggccgaacgcattcgacttccgccgcatggaaaccgacaaaaaaggggaaaatgcccccgacaccaagcgtattaaagaaacgctggaaaaattcagtttggaaaatatgcgttatgtcggcattttgaagtccggacagaaagtctccggcttcatcgaggctgaaggttatgtctacactgtcggtgtcggcaactatttgggacaaaactacggtagaatcgaaagcattaccgacgacagcatcgtcctgaacgagctaatagaagacagcacgggcaactgggtttcccgtaaagcagaactgctgttgaattcttccgacaaaaacaccgaacaagcggcagcacctgccgcagaacaaaattaagaagaggattactccattatgaataccaaactgacaaaaatcatttccggtctctttgtcgcaaccgccgcctttcagacagcatcggcaggaaacattacagacatcaaagtttcctccctgcccaacaaacagaaaatcgtcaaagtcagctttgacaaagagattgtcaacccgaccggcttcgtaacctcctcaccggcccgcatcgccttggactttgaacaaaccggcatttccatggatcaacaggtactcgaatatgccgatcctctgttgagcaaaatcagtgccgcacaaaacagcagccgtgcgcgtctggttctgaatctgaacaaaccgggccaatacaataccgaagtacgcgggaacaaagtttggatattcattaacgaatcggacgataccgtgtccgcccccgcacgccccgccgtaaaagccgcgcctgccgcaccggcaaaacaacaggctgccgcaccgtctaccaagtccgcagtatccgtatccgaaccctttaccccggcaaaacaacaggctgccgcaccgtttaccgagtccgtagtatccgtatccgcaccgttcagcccggcaaaacaacaggcggcggcatcagcaaaacaacaggcggcagcaccagcaaaacaacaggcggcagcaccagcaaaacaacaggcggcagcaccagcaaaacaaaccaatatcgatttccgcaaagacggcaaaaatgccggcattatcgaattggctgcattgggctttgccgggcagcccgacatcagccaacagcacgaccacatcatcgttacgctgaaaaaccataccctgccgaccacgctccaacgcagtttggatgtggcagactttaaaacaccggttcaaaaggttacgctgaaacgcctcaataacgacacccagctgattatcacaacagccggcaactgggaactcgtcaacaaatccgccgcgcccggatactttaccttccaagtcctgccgaaaaaacaaaacctcgagtcaggcggcgtgaacaatgcgcccaaaaccttcacaggccggaaatctcccttgacttccaagatgtcgaaatccgcaccatcctgcaattttggcaaaagaatccggaatgaacattgttgccagcgactccgtcaacggcaaaatgaccctctccctcaaggatgtgccttgggatcaggctttggatttggttatgcaggcgcgcaacctcgatatgcgccagcaagggaatatcgtcaacatcgcgccccgcgacgagctgcttgccaaagacaaagccctcttacaggcagaaaaagacattgccgatttgggtgcgctgtattcccaaaacttccagttgaaatacaaaaatgtggaagaattccgcagcatcctgcgtttggacaatgccgacacgaccggaaaccgcaacacgcttatcagcggcaggggcagcgtgctgatcgatcccgccaccaacaccctgattgttaccgacacccgcagcgtcatcgaaaaattccgcaaactgattgacgaattggacgtacccgcgcaacaagtgatgattgaggcgcgtatcgtcgaagcggcagacggcttctcgcgcgatttgggcgttaaattcggcgcgacaggcaagaaaaagctgaaaaatgatacaagcgcattcggctggggggtaaactccggcttcggcggcgacgataaatggggggccgaaaccaaaatcaacctgccgattaccgctgccgcaaacagcatttcgctggtgcgcgcgatttcctccggtgccttgaatttggaattgtccgcatccgaatcgctttcaaaaaccaaaacgcttgccaatccgcgcgtgctgacccaaaaccgcaaagaggccaaaatcgaatccggttacgaaattcctttcaccgtaacctcaatcgcgaacggcggcagcagcacgaacacggaactcaaaaaagccgtcttggggctgaccgttacgccgaacatcacgcccgacggccaaatcattatgaccgtcaaaatcaacaaggactcgcctgcgcaatgtgcctccggtaatcagacgatcctgtgtatttcgaccaaaaacctgaatacgcaggctatggttgaaaacggcggcacattgattgtcggcggtatttatgaagaagacaacggcaatacgctgaccaaagtccccctgttgggcgacatccccgttatcggcaacctctttaaaacacgcgggaaaaaaaccgaccgccgcgaactgctgattttcattaccccgaggattatgggtacggccggcaacagcctgcgctattgatgcgtcaaaataagggcatatgttttacggcatatgccctttctttatgctttttgccgcgaccgaaatgccgtcattcccgcgcaggcgggaatccagtccgttcagtttcggtcagtttcggtcatttccgataaattcctgttgcttttcatttctggattcccacttttgtgggaatgacggcggaaggggtaaatcctcacaacccaaagcctcgtcatttccacaaaaaacagcaacccgaaacagcaacttaaaaccccgtcattcccgcgcaggcgggaatctaggtctgtcggttcaggaacttatcggataaaacggtttctccaaccctgcgttctagattcccactttcgtgggaatgacgggatatgggtttccgtgcggacgtgttcggatttccgcctgcgcgggaatgacggcgacagatgcccaacggtctttatagtggattaacaaaaatcaggacaaggcgacgaagccgcagacagtacaaatagtacggaaccgattcacttggtgtttcagcaccttagagaatcgttctctttgagccaaggcgaggcaacgccgtactggtttttgttaatccactatagtattgataaacatattatcttcaatatattcaattggataattgtttacctaagcaaagataattgccttttcctgacaaataagtgaaatcaacggattgtcaaaacacagcctgaaataaaaaacctccctgatttcttttatttgtccttaaaatcagaaaggttcgggatggtcgggttatttttccaaacgtaccgccgccctgccgatttcgtataaaattccgccgtaacccgacaagcccgaaccctgtcgccccgaaaggcggggtgtcaaacattaaggaattgtgatgaaaaactttaacggcaaactcatcctcatcggactgatgggcgcgggcaaaaccacgctgggccggcaaatggcgcagcggctggattaccgtttttacgacagcgatcacgaaatcgccgcagccgccggcgttcccatccccaccatatttgaaatggaaggcgaacagggattccgttcgcgcgaaaccgccatactcaaaaagctggttatcctgccccatatcgtcctgtccaccggcggcggcgcggtgttaaaagaagaaaaccgcgcccttatccgcaaaagcggcacggtcgtctatctgcacgccccgcccgaaaccctgctcgaacgcacgcgctgcgacaacagccgtcctttgctgcaagttgccgatcctttggcgaaattacgtgaactctacgccgcacgcgaccccgtttaccgccaaaccgccgactttaccgtagaatcggcaaactgccgggaaaccgtgcaaaccctgctcaaacgcttatcccgataaaccggcatatgcgccgcgcccagaaaaccaaaccgcgccccgcccggcgggccggcggttcaaactttaaggaacaacaatgaaaacactgaccgtacacaccccgtcccacagctaccccatctttatcggcaacggactgctgccgcaggcaggaagcctgctcaaaccgcatttgggcaaacgcgccgccatcatcgccaacgaaaccgtcgccccgctctacctcggcacgcttcagacggcattggatgcggcaggcgtatcccatttcagcatcatcctgcccgacggcgaggcgcacaaaaactggcagacgctcaacctcatctttgacgggctgatgcaaaaccgcgccgaacgcaaaaccacattaatcgcactgggcggcggcgtgatcggcgacatggtcggctttgccgctgccacctaccagcgcggcgcaccgttcgttcaaataccgaccacgctgttgagtcaggtcgactcatcggtgggcggcaaaaccgccatcaaccacccgctcggcaaaaatatgattggcgcgttttaccagccgcaggcggtgcttgccgacttggacacgctgcacaccctgcccgcccgcgaattgtccgccggtatggcggaagtcatcaaatacggcgcgctcggcgacatcggcttttttgaatggctggaacagcatatgcccgaactgatgacgctcgatcgggaaaaactcgcccaagccgtgtaccgctgctgccaaatgaaggcagacatcgtcgcccaagacgaaaccgaacagggcatacgcgcatggctcaacctcggacacaccttcggacacgccattgaaaccgagatgggttacggcacttggctgcatggagaagccatcgccgccggctgcgtgttggcggcgcgtttgtccgaacaactgggcaaaacctccgccgcagataccgcgcggctcgccgccctgctcgaagccgccggactgccgtccgcgccacccgtgtttgcctttgaaaaatggctggaacacatgagccacgataaaaaagtcagcggcggcatcatgcgctttatcggtctgaaccggctgggcgaagccaacatcaccgaaattaccgacacggacatcctccgccgcaccctgcaaccgtatctctgatttcctctgccgatgtgctgccgcgcgggtttgacgcacgatgatgattttccatcatctttctccgcaaaagcgggaatccagtccgttcggtttcggtcgtttccgataagttcccgttgcttttcatttctagattcccactttcgtgggaatgacggcggagaggtttttgttgtttcggagaagtttctgcaaccctagaatctcgttatttccacaaaaaacagaaaaccaaaacagcaacttaaaacctcgtcattcccgcaaaagcgggaatccggtccgttcggtttcggtcgtttccgataaattcctgctgcttttcatttctagattcccacttttgtgggaatgacggcggaagggttttggttttttccgataaattcttgaggcattgaaattctatagtggattcacaaaaatcaggacaaggcgacgaagccgcagacagtacagatggtacggaaccgattcactcgtgcttcagcaccttagagaatcgttctctttgagctaaggcgagacaacgccgtaccggtttttgttcatccactataacagcaaccctgtcgccgtcattcccgcaaaagcgggaatccagtccgttcggtttcggtcgtttccgataagttcccgttgcttttcatttctagattcccactttcgtgggaatgacggcggaagggttttggttttttccgataaattcttgaggcattgaaattccagattcccgcctgcgcgggaatgacggctcaaaagttacggaacgaaaaacaaccaaaaccggacaagtcggattcccgcctgcgcgggaatgacggaatcttaagtttccgtctttgttttctgttttctgttttcgagggaataatggggaacaagccgtatttcagacggcattttcagttcggggtataatccgaatacttgcgaccatctgaatcattgggacaaaccatgtgtcaactgctgggcatgaactgcaatacgccgaccgatattatgttttcctttgaaggcttccgccgcaggggcggcattaccgaccaccatgccgacggtttcggtatcggctttttcgaaggcaaaggcgtgcgcctgttccacgacgacaagccgagcgtaaattcccccgtcgccgacctcgtgcgtgcctaccaaatcaaatcggaaaacgtcatcgcacatatccgcaaagcatcgcaaggacaaacctcgctggcgaacacccatccctttatgcgtgaaatgtggggcggctactggctgtttgcccacaacggacatttgattgattttttccccgaacagggcgaatttttccaccccgtcggcacaaccgattccgaacgcgcgttctgccacatcctcaaccgcctgcgcacccgctttgccgcccgtcccgacgacgacacgctgtttgacgcgattgcggggctgacgcacgaaatccgcaagttcgggctgtttaactttatgctttcagacggcattgccctgtttgcccacgccagcacgctgctgcactacatcgtccgccaagccccgttcggcaaggcgcgcctgctcgacgacgacgtgatggtcgattttgccgaagtaaccacgccctccgaccgcgtcgccgttatcgccaccctgccactgacccgcgacgaatcatggtcccaacttgccgtggacgaactggtcatgttccgcgaaggcaacatcgtccgacacgaccgtcccgaaaaccccgtctatatgagtgccgaagaaggtctggaaatcgcccgcgccgccggcgtcgccgtctgaacttcagacgacataggaggacgaacccgatgaaatgcccgttttgcgcccaccccgacacccgcgttgccgattcgcgtctgatggaagaacgcaacgccgtgcgccgccgccgccactgccccaactgcggcaaacgcttcggcacgctcgaaaccgccgaactcaaaatgcccgccgtcatcggtccggacaaaaaacgctcgccctttaatgcacaacgcctccgcaacgacctgaccgccgccgcccgaaaatccgccctgacacccgaacagatcgacgaaaccgtccgcctgacggaacacaggctctacacttcgggtcagcgcgacatcccctctgccgcacttgccgacatggtgctaaaagaactgctccgacaagatacggaagccgccgtccgtttcgccgccctgcacaaacgcttcgacaatccggcagactttgcctcgtggctggcgcaagccgtcaaaacaggcggcaaagcctgattcccccaacccatactgatacggtatccctatgttttcggacacagatatatccatgatggaaaacgccctccgacttgccgctttggggcgtttttccacttcgcccaatccgcgcgtcggctgcgttatcgcacacggcagccaaattgtcgggcaaggcttccacgtcaaagcgggcgaaccccatgccgaagtccacgccctgcgtcaggcgggcgaaatggcacaaggcgcgaccgcctttgttaccctcgaaccgtgcagccattacgggcgcacaccgccctgtgccgaagcactggtgcgggcgggcgtgtcccgcgtcgttgccgccatgcgcgaccccaacccgctggttgcaggcaaagggcttgccctgctcgaagcagcaggcatcaagacggaatgcggtttactcgaacatcaggcaagggaactcaaccgaggcttcctgtcgcgcatcgaacgccgccgcccctttgtccgcctcaaatgcgccgtttcgctggacggcaaaaccgccctttcagacggcagcagcttttggattaccggcgaagacgcgcgtgccgacgtacaggttttgcgtgccgaaagctgcgcggtgctgaccggcatcggcacggtgttggcggacaatccccggctcaacgtccgcgcttttccaactttgcgccaacccgcacgcatcgttttagacagccgcctgcgcctgcccccgaacagccatttggttaccgacggacaatctccgacctacatcgccacactcgaacgcaacgaagacagactgcacccctatcgggaacacgcacacgtccgcatcctgatgccgtctgaaacggcagacagcaaaatcgacctgcaccacctgatgcgcctccttgctgacgaaggtttcggcgaaatcatggtcgaagcaggctccgaactcacatccgcatttttggcagaaaatctggcagacgaaatcgtcctgtaccgttcgcccaaaatcctcggcagcggcaaagacctgttttccctgctcgaaaaccgcgccgccctttccgcaccgcccttgtggacacccgtttcaagcgaaatcctcggacacaacatcaaaaccgtgttccgaaaaaacggcaacgccttttaaagggtttgcgccgtttcactatataataacgccgataaaaaacggccccgttcagaccgccgcccgcccgaaaaaacgcaacccggactgccgcaccccgccggcagccgcgacggtctgaaagccgtcaaattccgatcaagaaaggcttcagacggcacaggcagcatcccgccgccgcccggacatcaaaaatggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatgaaaatcgttttgaccacatctatggcaggcttgggcggcacgggcacgatatcatcgattgccaaatggcgtgcaaaaacgaccccgttcagtccgacgaaatcgtccgccgcttcaggcgcgacatttcctatcggaaaatcgtcaacctgattgaaagattggcaaatgagtaaattcttcaaacgcctgtttgacattgttgcctccgcctcgggactgattttcctctcgccagtatttttgattttgatatacctcatccgcaagaatctaggttcgcccgtcttcttctttcaggaacgccccggaaaggacggaaaaccttttaaaatggtcaaattccgttccatgcgcgacgcgcttgattcagacggcattccgctgcccgacggagaacgcctgacaccgttcggcaaaaaactgcgtgccgccagtttggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaagccaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgttctggttcatccggacgcgaccgtctcgccttctgcaacagtcggacaaggcagcgtcgttatggcgaaagccgtcgtacaggcaggcagcgtattgaaagacggcgtgattgtgaacactgccgccaccgtcgatcacgactgcctgcttaacgctttcgtccacatcagcccaggcgcgcacctgtcgggcaacacgcatatcggcgaagaaagctggataggcacgggcgcgtgcagccgccagcagatccgtatcggcagccgcgcaaccattggagcgggcgcagtcgtcgtacgcgacgtttcagacggcatgaccgtcgcgggcaatccggcaaagccgctgccgcgcaaaaaccccgagacctcgacagcataagcgattaaaatacacccccgtacagaccgattttgacaacacctgcggcgcgcgcccgattcttcggaacacgccccccttcagacggcatagggtcggaaatgccgtctgaaaaccgacggacaaaccatcatgctgaacactttcctttccccgtggccctgcttcacccaagaagaagccgatgccgtttccaaagtcctgctgtccaacaaagtcaactactggacgggcaacgaatgccgcgaatttgaaaaagaatttgccgcctttgccggcacgcggtacgccgtcgcccttgccaacggcacgctggcactcgatgtcgcgctcaaagcaatgggcataggcgcgggcgacgatgtgattgttacctcgcgcaccttcctcgcttccgcgtcctgcattgtgaacgcgggcgcaaaccccgtgtttgccgatgtggatttgaacagccaaaacatcagcgcggaaaccgtcaaagccgcgctgacaccgactaccaaagccgtcatcgtcgtccacctcgccggtatgcccgccgaaatggacggcattatggctttggcaaaagaacataatctttgggtaatcgaagactgcgcccaagcgcacggcgcaaaatacaaaggcaaatccgtcggctctatcggacacgtcggcgcgtggtcgttctgccaagacaaaatcatgaccaccggcggcgaaggcggtatggttacgaccaacgacaaaaccctgtgggaaaaaatgtggtcgtacaaagaccacggcaaaagctacgatgccgtgtacaaccacgaacacgcgcccggtttccgctggctgcacgaaagtttcggcacaaactggcgtatgatggaaatgcaggcggtcatcggacgcatccagctcaaacgcctgcccgaatggacggcgcgccgccgagaaaacgccgccaagctggcggaaagtttgggcaaattcagcagcatccgcttggttgaagtcgccgactacatcggacacgcgcaatataagttctacgccttcgtcaaacccgaacacctcaaagacggctggacgcgcgaccgcatcgtcggcgaactgaacgcgcgcaaagtcccctgctatcaaggcagctgctccgaagtctatttggaaaaagccttcgacaacacgccgtggcgaccgaaagagcgtttgacaaatgctgtcgagttgggcgacaccagcctgatgttcttggtgcacccgacgctgaccgacgacgaaattgcgttttgcaaaaaacacatcgaagccgtcttgaccgaagccgcacgataacccttcagacggcatatgccgcctgaaaacacataccgccccacgatatgaatctggaaactctgatcgccctgccgcgcaacatcaagaaaatctgtttcctcatacacgattttctgatgattttcattgccttttggttcacccaaagcctaaaggccgactactcggacgaatggttcgattttgccaactggcagtcttttttgctgactgccttgctgaccatcacattatttatccgaatggggctttaccacgccgttacacgcttcgtcagcttccgcatcctcaccaccgcactggcgggcagcctcgcctccgccgtgttgtttttcctcaatacgctgatatttgaagaaaggctgcgcctcgccctgccgattgtctatttcttactgctgtttgtttccgtgaccggctcgcgtatggttttgcgcggactgttgtccgaacaccccaaaaaacagatgatccctgtcatcatttacggcgcgggacggtcgggcagacaactgcttgaggccgtcaaacaaatgcgcgaatattccgccgccgcctttgtagacgacgaccccaaactgtggcacaccgtcatctacgaccttgccgtttaccagcccgatgccatcgccttcctcatcgaacgctacggcgtggaaaaaatcctgctcgccatccccggcgcgacccaggaacaacgccgccgaatcatcaacaaactggaagcctatccgtgcgaagtgttgaccattcccggaatgaaagacctgatggacggaaaaatcagcatcggcacgctcaaaaaaatctctgtgtccgacctgctcgggcgtgattccgtcgcgcccgacgaccgcctgatgagtgccgacatcgaaggcaaaaccgtcatggtaaccggcgcgggcggctccatcggttcggaactctgccgccagattatccgccgccgccccgaaaagctgctgctgttcgagttatccgaattcgccctgtacgccatcgaaaaagaattgcgcgaaacctgcatccaaaaacgcctcgacaccgaaatcctgccctttctcggttcggtgcaaaaccgcacgctgctcgaacacgtcatgaccgccttttccgttgcgaccgtctatcacgccgctgcctacaaacacgtccccatggtcgagttcaacaccgtcgaaggcatacgcaacaacatcttcggcacactcgagtgcgcgcttgccgccacgacatcgggcgtaagaactttcgtcctcatctccaccgacaaagccgtccgccccaccaacaccatgggtgccagcaaacgcatggcggaactctgccttcaggcactcgccgccgaacccggacaaaaaacccgcttcagcatggtacgtttcggcaatgttttaggttcgtccggctccgttgtcccgctgtttgaaaaacagattgcagaaggcggcccgcttaccctgacccaccccgaaatcacacgttatttcatgaccatacccgaagccgcccaactcgtcatacaggcaggcgcgatgggtacgggcggcgacgtattcgtcctcgacatgggtgaatccgtcaaaatcatcgaccttgcccgccaaatgattaccctaagcggcctcaaacccaacacacccgaacaacccgacggcgacatcgaaatcctcattaccggactgcgtcccggagaaaaactctacgaagagctgctcatcggcgacaacgtccgcaaaaccggccatccgcgcatcatgaccgccaacgagaccatgctgccgtggcacgagctctccgccctgctcgaccgcatccgtgcggcctgcgaccgttacgaccagcaggcaatccgcaccctgctcatcaacgccccgaccggctttgccccgagcgacggcatctgcgacctgctttgggtacgagaaacacacagaaaaaatgccgtctgaaccttcagacggcataacgtacaaaccaacctaccttacacacacggagtttgacatgcagttctcagcattcggcgaaaaattcacgcaacacagcggcatcctccaactgatggacgacctcggcgacgcgctcaaaagcgacaagcccgtcaacatgctcggcggcggcaacccggcgcgcattccggaaatcgatcaggcgttcgccgacatattctccaaactggcggcagaacacgccgtcgaaaacatcggcaactactccaatccccaaggcgatgccgtgctgattgacgcgctgaccgccttcctcaaccgcgaatacagctggaatctgaccgccgacaatatcgcgctgaccaacggttcgcaaaacgcgtttttctatcttttcaacctcttcggcggcaaattcaacctttcagacggcacatccgcagaaaaagccattttgttgccgctcgcgcccgaatacatcggctatgccgacgtgcatgtcgaagggcagcacttcgtttccgtcaagcccaaaatcgaaaacgtcgaacacgaaggcgaagccggcttcttcaaataccgcgtggactttgacgcactggaaaacctgcccgaactcaaagcgggcaaaatcggcgcgatttgctgttcgcgcccgaccaacccgaccggcaatgtgttgaccgacggcgaaatggcgcgtttggacgctttggcgcgtgaacacggcattccgctgattatcgacaacgcctacggaatgccgttccccaacatcatttacagcgacgtaacgctgaattggcacgaaaacatcatcctctgcttcagcctgtccaaagtcggcctgccgggcgtgcgcaccggcatcatcgtcgccgcgcccgaagtcgtcaaagccgtcagcagcctgaacgcgattgtgaaccttgcccccacgcgcttcggcgcggccatcgcaacgccgctgctggaaagcggcgagatgaaacggcttgccgaccaagtcatccggccgttttaccgcaatcaggcgcaaaccgccgtctcgctgctcaagcgggagctgggcgcgtacccgatgaaaatccacaaacccgaaggcgcgattttcctgtggctctggtttgaaaacctgcccgtttcttcgcaaaccctgtacgaaatgctcaaagccgaaggcacactgattattccgggcgaacatttcttcgtcggcatcgacacgcaggattacccgcatgcgggcgagtgcatccgcatgagcatcgcgcaggacgctcaaacgctggaaaaaggcattgccgccatcggtaaaaccgtccgaaaactgtacgacaacgtttaaaacgcaaaaaatgccgtctgaaaagttttcagacggcatttttatctgcattcaatatcgggaaaaatgttcccaaaccggtttgcagttttccggcagctcgggacacgcgccgaggatgccgccgctgaagtcgtttaagcggtggaagtcgctgcccgcgctggcgagcataccgaagcgttctgccaaaagcgcgtagttgaggcggtcgtttttgcagcagtttccgctgtggacttcgatgcctgcgccgccgaggtttttaaattcttcaaacaaattgcgcttggcggtggcggacaaatcgtagcgcatggggtgggcgatgactgccatgccgcccgctccgttgacggcggagacgcagtcttccagcgtcgcccattcgtggcggacggcgcaggatttgccgtcgcccaagtatttggtgaacgcctgctgcttgtttttgacgtgtcccgcttggatgaggaactcggcgacgtgggtgcggctgaccatttctttgtttgccgccagtgccagcgcgccgtcgtatgcgccgccgatgcctttcttttcgagcttggcggcgatggcttcaagacgtttcagacggcctttccgcacttgcgccaacaggttttgcaggttttcgtcctgctcgtcgaaatccaaaccgacaacgtgtatggtgcgcccgcgccacgttacggagatttccacaccgttaatcaggcgcaaaccgagcttgtcggcttcggcgcgcgcttcggcgatgccgccggtgtggtcgtggtcggtcaacgccagcagcgtgcagccgttttgatgcgcgaggcgcacgacttcggcgggggagagcataccgtcggaaacggtggaatggcagtgcaggtctatcatggggtgttatgtgtgttgtgaatgaaggtcgggggttaatattatcggttggtgtggatacagcggtgatttcaacaaacaggtgtatggcaaatgcaaaggaaaagtccctatgccgtcattcccgcgcaggcgggaatccagaccttgatttgtcaaaaatatttaaggttaaccgctatttcgaacttccggattcccgcctgcgcgggaatgacgatatggacgttttcagttttaatctactataaaagactgtctgaaaacgtggttttatagtgaattaaatttaaaccggtacagcgttggctcgccttggctcaaagagaacgattctctaaggtgctgaagcaccaagtgaatcggttccgtactatttgtactgtctgcggctcgccgccttgtcctgatttttgttaattcactatatcaagccgaaccgtttcagacggcatcgtccgaccaacccgcttctttcaatttctgccgttgcacgtcgtatttggctttatccgcccagtaaatcgtctgaatgcacgcctcgccgcagtcgctgccgcagcattcccacgactcgggtcggacgggttcgtctaaaagcggctcgcccaaaagggcttcggctttatacttcagggtcgtatccatcggcgatttccaagcgagcgccgtcaaactcgatgacttcgccgccgcgtattttggcggttttacgggtttcggtttcgccgttgcgcaacaccagcccttcggcgataaacgctttcgcctgtccgccgctttcggcaagtccgaccaatttcaagaggtcgcacaaggcgatgtattcgttgtcttcgagatagacagtggcttccataatgttcccttgcagaaagaggccgttattgtagcacctgccgccgccgtacccaaaattaccgaaaaaccggcgatgtatccgcaccgcctgttccgtaaaagtaaaaatgccgtctgaaaccccatatgccgccatccgttcaaagaaatcctgcccaacggcagactgcaaatcctgttccccgacgaatccgcattgacgctgatgcacatcctcaaacgcgaactgcccgatacaccggcaatcggcatcaaaacgaaatcaaaaacctgtttgaacgtaaaattaatttaactgcttgccatccgtccgaataaggcatatagttctttataactagtttgatagtcctttatatctatcaatactccttgggaagcctccgccatacggcaggaggcatttttttgccgtagtaaaagctcaaaaacatttgcaggtcatgccgtctgaacccgaaacggcattacctacaccgccatctaaagacaaccctgctacaatacgccttttattgtccacgccgattttgccatgaccgagccgacctacattcccctgcgcctgcataccgaattttcgattaccgacggtatggtgcggattaaaaaactgattgccaaagcgcaggaatacggtttgcctgctttgggcatcagcgatttgatgaacgaattcggtttggtgaaattttataaagcctgccgcagcgcggggattaagcctatcggcgcggcggatgtgcggataggcaatccggatgcgcccgacaagccgttccgcgctatgctgattatccgtaacgatgcgggctatctgcgcttgagcgagcttctgacggcggcttatgtcggcaaagaccgcaatgtccatcatgcggaactcaatcccgaatggctggaaaacggcgacaacagcggcttgatttgtttgagcggcgcacattacggcgaagtgggcgtgaatctgttgaacggcaatgaagacgcggcgcgtacggcggcgttgaagtatgcggcgtggttccccgatgcgttctatatggagctgcaacgcctacccgaacgccccgaatgggaggcttgcgtttcgggcagcgtgaagctggcggaggaattgggtttgccggtggtggcgacgcatccgacacagtttatgagccgcgacgatttcaacgcgcacgaggcgcgagtgtgtatcgcaggcggctgggtattgacggacaagaaacgtccgcgcgatttcacgccgggccagtttttcattccgccggaaaccatggccgaacgtttcgccgatttgcctgaagccttggaaaacacggtagaaattgccaaacgctgcaacctgcacatcacattgggcaaaaacttcctgccccttttccccacgcccgacggtttatcactcgatgactatctcatcaaactctccaacgagggtttgcaggaacgtatggttcagctttatcccgacgaggcggagcgggcggcaaaaatgccggaatatcaggaacgtttggattttgagctgaacatcatcatccaaatgaaattccccggctatttccttatcgtacaagactttatcaactgggcgaaaacacacggctgtccggtcgggccgggccgtggttcgggcgcgggttcgctggtggcgtattcattgaagattaccgaccttgatccgctcaaatacgcgctgctgttcgagcgtttcctaaaccccgaacgcgtttctatgcccgacttcgacgtggacttttgccaaagcaaccgcggccgcgtgattgaatatgtgcgcgagaaatacggcgcggaggcggtcagccagattgttaccttcggcacgatgtcgtccaaagcggtcatccgcgacgtcgggcgcgtgttagagctgccgtttatgctgtgcgacaaactgtccaagctgattccgttggaagccaacaaacccctgagtttggaaaaagccatggagaccgagccacagattcaggaattaatcgaagcggaagaagcggacgaactgattacgctggcgaaaaagctggaagatttaacgcgcggtttgggtatgcacgcaggcggcgtgttgattgcgccgggcaagatttccgattacagccccgtgtatcaggcggacgaatccgcctcgcccgtatccatgtacgacaagggcgacgtggaagatgtgggtttggtgaaattcgactttttgggtctgcgcaacctgaccattatcgaaatggcgcagaacaacatcaaaaacactaccggcgacatcatcgatgtcggcaaaatcccgcttgacgaccaggtcgcctaccaaatcttccgcgatgcgaacaccaccgccgtcttccagtttgagtcgaccggcatgaaaaaaatgctgaaaacggcgcacacgaccaagtttgaagaactcatcgccttcgtatcgctctaccgccccggcccgatggacaacattcccgacttcgtcgcacgtatgaaggggcaagaattccaatacatccatccgctactcgaaggcatcctcgcgccgacctacgggattatggtgtatcaggaacaagtgatgcaggcggcgcaaattatcggcggctactcgctcggcggcgcggacctgctgcgtcgcgccatgggtaagaaaaaacccgaagaaatggtgaaacaccgcgaaatcttcgccgaaggcgcggcaaaacaaggcatttcgcgcgaaaaatccgacgaaatcttcaactacatggaaaaattcgccggctacggtttcaacaaatcccacgccgccgcctacgccctgatttcctaccagaccgcatggcttaaagcgcactaccccgccgaatttatggcggcgaccatgtcgtccgaattggacaacaccgaccagctcaagcatttctacgacgactgccgcgccaacggcattgagttcctgccgcccgacatcaacgaatccgactaccgcttcacgccgtatccggacatgaaaatccgctacgcgctcggcgcgattaaaggcacgggcgaagccgccgtcgaatccatcaccgccgcgcggcaaagcggcggcaagtttaccggtctgttggacttctgcgagcgcgtcggcaaagaacacatgaaccgccgcaccctcgaggccctgatacgcggcggcgcgttcgacagcatcgaacccaaccgcgccatgctcttggcgaacatcgacctcgctatggacaacgccgaccaaaaagccgccaacgccaatcagggcgggcttttcgacatgatggaagacgccatcgaaccggtgcggctcatcgacgcgccgatgtggagcgaatcggaaaaactcgccgaagaaaaaaccgtcatcggcttttacctgtccggccacccgttcggcccgtatgcccaagaagtccgccaaatcgcaccgaccaaattagaccgtctgaagccgcaagacagcgtgcgcctcgccggattcgttaccgccgtgcgtacgatgatgggcaaacgcggcaaaatcgccttcgtcagcctcgaagatttgagcggacaggttgaaatcatggtcggcggtcagacgttggaaaactgcgccgactgcctcaaagccgaccaagtgctgattatcgaatccaaagtcagccgcgacgactacggcggcggcgacgggctgcgtattctggcaaaccaagtcatgaccctgcaaacggcgcgcgaacgctacgcccgcagcctcagcctcgccctcgccccgcatcacgacatcggcggactggtacggctgctcgccgcccaccaactgcccgacacgccgcgcatcccgctgcaactgtcgtatgccaacgaaaaagcgtcgggcaggcttcaagtgccgccgaaatggacggttacaccgagctccgcattgttcggcgaactggaaacattgctcggcagccggtcggtgcgcgtcaactggtaacccaaaatataaatgccgtctgaagcccaaaaaccggtttcattcgtactttattcgaatgattgaataaaagtaactgccaagaaaaacgtattttttggttatttcgccagtctaaatagagcaaccgggacgattgatatccgtgtgcatgacacagacagcaccaaagggaaaaacggcattttccaaagtatcggtatcaaaaccgccctttcactccaaaaataccaaatcgacaaaccgggcaaagaaatcagaccgtgccgcctgaaaaaacgcccacccgtccgttaaattaacctatccctgtttcagacggcctgaagcagggatttttatatcaaaataaaatgagaaagggagcaataacccttaggtagctcttgttattttccgatgcaaaacaaagcagtcatatatttaattccccctacctctgccaagccttcctcaaatattcgacgcaatcggtcagcgagtagaacgggacattgccgtggtcggcattcggatattcccggaaaaagacggcggccccgtgcctgtctaactctgccgccatttgttcggcctgccctgccatatcgcgttcttccctgcgtttacaatcgctaccccgttctagcgcgccgatgttgaggcagacatcgatgccgtttagccggttttcagacggcataaagtcgagtatccgcctgttgtgccaccaaatcgatggggatacgagccaatgccgtctgaaacggcggtgggaaagcagggaatacagtccgaacagtgcgccgaacgagtgtccgaatacggcggtttcattgcggttgagggtgtagcggctttctaaaaaggcggtcagctcgctgtcgataaaggcggcgaagcggtctgcctgtccgaactgctgccgttcgtctgctgtggcgttgtctccaagcggcggcgtgtagtcggcggcacgttgtgccaaatcgcgcacactgcctgtcgtgtagccgataccgacaatcaggcagggggcgttgcttcgggtaacggggttgttcatcagcgactgcatgatgttgaaaagtgcggggaaaaaggcttcgccgtcgaggacaaagaggacgggatagccttcagacggtatttcgccgagtgttgccgtctgaatccgatagattcgccccgtgcaggtggatttgatttcggtttcaaaggcttggggcagtatggcaggttggaatgtgtcggtcggtatgggtttcatgatgttcggcttgtgggtcagactggcggcaagcggtaaaaccgaaccggcaaagcggtctgcctgccggttcggtctattttccttcgcaatgccatactccagttgtgagagcatagggtatgccgcgcagcttgttgtagtttgatgatgctgcggctgccgtttcagacggcatattggtctttaaaaactgtaacgcaggtttgccgtcaggctgcgctccgaaccgggaatgttaaaggtgctctcgctgccgacgcgggcgtagtaatggcggttgaagatgttgtcggcgttgatttgcagcttcagtttgggcgtgaagcggtatgccgccatcgcatcgaacgtggcataaccgcctgcatgtatccctgcagatgaagtaatgccgctcatcgcgttcacgccgccgccgatggtcagcccggacgtaacttggtaagtcgtccacaggtttgcgctgtgtttgggcatcagcaggaagatgccttcgtcgcgcgaattggaggcggttttgatttggctgtgcaggtagctgtaacctgcatggatttgccatttcggtgtcatcgcgccgctgatttcggtctcaacaccttccatcacgcgtttgcccaatgcggcgtaacgggtttttttgttgtttgagtccagcggtgcggcggcgtttttatccttcatgcggtagaacgaaacccgggtattgaggcggtcgtccatgtagctgcctttgtagccgatttcaaactggttgccttcgcgcggtttgagcagcttgccgtcggtgccgatgctggtttgcggtgtgtagagttgggaggcggaagcgtacaggctgttgctgccgtctatatcgtaaaccgcgccggcgtagcttgtaaatttggttttcgaagctttatgcagggttttgccgtcgcccgactcgattttgtgatgtcctacacgtccgcctgcaatcaacgacaaaccttccagaggacggaacaccgtcttggcatacaaaccggtttcgtcgaggttttcttcggtaacggagtgattgaaacctttgtttccggcgcgggcgttctgaagtatgccgttataaggcaaagcgcggaaaccatctaaagcgacgctttttgacaaagtcgaacgcccttgttcattagtactgcgcaagcggttgtagtctgcaccaatcacaaattcgttggcggtgttgcccaaggcaaacggacggctgtaacttgcgtcaaccgcaaaggctttttgtttaatgtccgtacccaaacccgctacgtcggcttgtccggtattgttgagtttgctgcccgcaaacgtataattggaatcggctttccgatcggaatagcgcataccgactttgccgtagccgccgttgccgaagtaatgtttcaaatcggcgaacacgtcgtggctgtgcattttaaatttgttccaatccgcgccgacaaatacgtgttgcggcagggacggtaatttgttattggcatcggcaggcaggccgttgtacggcgcgaggcggcgttgctggtaaagatagcccgcgcccaaaaccgtatcggggttgatgtcccaatccgccgccgcgtagaaggtttcgcgccggttgtttttctcggcgggacgcggagacgcgccgacggtctgcgccatcacgcggccgcgcacgctgccgtctgaattgaggctgcccgatacgtccgcctcggctttatattgtttgtgcgtaccgaaccctgccgccgcatgaccttggaacgctttggtcgggcgtttgcgcaccagattcacgatgccgcccatctcgccgctgctgtcgaacagtccgctcggcccgcgcatcacttccacgcggtcgaaggcgaacaggttgggcagcgtgccgttgatactctgcatctgcgcgggcaggccgtcgatgttgtattcgctgtattcgtaaccgcgcgcgtaaaccgaagagcgtccgtcgtcgttgctcaacacgcgcaggccgggcgttttgcgtgccaactggtcaaacgtatcaacattgcggtctttgacctgctggttggtaatgatgctgacggattgcggaatttcgcgcaaagaagcggggatttttgtaccgacggtggcggcaaacgagctgtaatcgccgtttttctcggtggcaatcgcgttgtaagaacgctgacccttaatatggacggtttccaaaccttccgtttgtgcggcaaaaaccgaagacgagagtgctgccaaaaccgtggcggcggtcatattgatgcggaaaactgacataaactgtcccattcacataaatgataatggttctattttaataaagcgcaacgcggcttgttcggaaaaacatatcgcgcagccgacaaattttgtcgaaaatgcgacacgtctgcgttttccgcataaaatttgcttttttactgcaaccaacctgctatgaccacgcccaaactcatcatcttcgactgggacggcacgcttgccgatacgacccaacccatcatcgacaccatgcgccgcagcttcgccgaatgcggttttccgccgcccgaagcggaacgcgtccgcagcctgattggctacagcctgcccgaaatcatccgcaccctgctcgaaatgccgtctgaaaccgccgttgccgacatcacacgcacttattccgcacattacctcaatcccaacaaccgcaatatgtccttatttcccgatgccctgccctgtctggacaagctcaaagcacaaggatactggcttgccgtcgccacgggcaaagggcgggcgggtttggacaacgccatcagtcaaaccgccaccggcggctattggctcgccaccgcctgcgcgggggaatatccctccaaaccctcgcccgaaatggtattcggaatctgcggcgaactgggactcgacccgaaagaggcattggtcgtcggcgatacggcgcacgacctgcatatggcggcaaacgcaggcgcggcggcagtcggcgtggccaccggcgcacattcgcgcgaacagctccttagcgcaccgcatctcgccgtattggacggtttgtccgaactgcccggttttcttgcacaacattacgcctgattggtttccgcatccggcacacggcaaaaatgccgtctgaagcctgttcagacggcatttgtgttgcccaaacattcaacgcctgcgtcaacgtttgcacaaatcgggtttggtttcgccctcgcggcgcaactctttgggcaggacgaacacaatgctttcttccgcaccctcgccttcgcgtacggtttcgtgcccccatccgcgtatggttgccagtacttcccgcaccaacacttcgggcgcggacgcgcctgccgttacgccgactttgtttttgccctcaaaccatgcgcgttgcaggtagcctgcattatccaccatatacgcatcgattccgcgcgatgccgccacttcgcgcaagcggttgctgttggacgaattgggcgaaccgaccacaatcacgatgtcgcactgttctgccaactctttgacggcggtttgccggttggtcgtcgcatagcagatatcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggcgcaagctgccccatcgttccttcgacctcgacgtgccccttatgcccgatcatgatgatttcacagtcttgggcatccagtcgggcgacttccttatgcactttcgtcaccagcgggcaagtcgcatcaaacacgcggaaaccgcgctccgccgcttcttgccgcaccgccttcgatacgccgtgtgccgaataaaccagtgtcgcgcccggcggcacttccgccaagtcttcaataaacaccgcacctttttcacgcaggttgtccacgacgaatttgttgtgaacgacttcgtggcgcacataaatcggcgcgccgaactcttccaaagcacgttcgacaatactgattgcccgatccacaccagcgcagaagccgcgcggattggcaaggatgatggttttctcgttcataagcccggtatttcgttttcagacggcatcaatatttttcttcttgggttttacggtggacgatgttgtccaacaccgccaacaccgcaccgacgcagataaagctgtcggcaatattaaaggcgggataaaaccaattttgccaataaaacaataagaaatcgacgacatgaccgtgtatcaggcggtcgatgacattgcctaacgcaccgccgataatcattgccgcacccgttttgccgagggttgcaaactcatcgcgcaagatggcgcgtaccaaatacgcgctcaccgccaccgccagcaccaaaaaaaagtatttttgccagccgccctgatcggcaaggaagctgaacgccgcacccgggttgtacaccagcgtcagatcgaaaaaggaaggaatgacattgacgcgttcccgatactgaaacgacgacagcaccgcccacttcgaccactggtccagcacgatggcggcaagtgccaatacccaatagcgcgttttacttgaaacagatgaagacatatttttcaacagccggtaaaagagtaccattttacccgaaaaccccctttcctgtacccgaaacggcaaatgccgtaatcttaaaacccgtcattcccgacaacaccgtaatctcgaaacccgtcattcccgcgtaggcgggaatccagacctgtccgcacagaaacttatcggataaaaacagttgcccaaaccccgcgttctatagtggattaaattcaaaccagtacggcattgcctcgccttgccgtactatttgtactgtctgcggcttcgttgccttgtcctgatttaaatttaatccactatagattcccacttccgtgggaatgacggttcagttgcattccgacaacaccgtaatcttgaaatccgtcattcccgcgcaggcgggaatctatcggaaatgactgaaacctcgagattctagattcccactttcgtgggaatgacggttcagttgcgttccaacaacaccgcaatctcgaaatccgtcattcccgcgcaggcgggaatccagacctccgacgcggcgggaatctatcggaaatgactgaaacctcgagattctagattcccactttcgtgggaatgacggttcagttgcgttccaacaacaccgcaatctcgaaatccgtcattcccacacaggcgggaatccagacccctgacgcggcgggaatctatcggaaatgactgaaaccccgagattctagattcccactttcgtgggaatgacggttcagttgcgttccgacaacaccgcaatctcgaaatccgtcattcccgcacaggcgggaatccagacccctgacgcggcgggaatctatcggaaatgactgaaaccccgagattctagattcccactttcgtgggaatggcggttcagttgcattccgacaacaccgtaatcttgaaatccgtcattcccgataacagcgcaatcttgaaacccgtcattcccgcgcaggcgggaatccagacctccgacgcggcgggaatctatcggaaatgactgaaaccccgagattctagattcccactttcgtgggaatgacggttcagttgcgttccgacaacaccgtaatctcgaaatccgtcattcccgcacaggcgggaatctatcggaaatgactgaaacctcgagattctagattcccactttcgtgggaatgacggttcagttgcattccgacaacaccgcaatcttgaaacccctccgccgttataaagacaaatcgcggcacaaaaaatgccgtctgaaatgctgttcggcggtttcagacggcatttgctcaaactttatcaggcgtaatggcgcgtttcgccttctccgccgacattctctgcacagcgtttgcagacggtttcatagcctgcaaccgcgcccacatcgcgggtgtagtgccagcagcgttcgcatttttcaccatcactggctttagcggcaacggcaagttcgctgcctactttcacttctgctttagacaccagcaaagcaaagcgcaattcttcgcccaaagcattcagatagccggccatttcttccggcgcggtaatttcggcttcggcttgcaaggacgaaccgacggttttgtcggcgcgcaaaggctcgatggcggcggttaccgcttcgcgggcttcgcggattgccgtccattttttcaccagttcggcttcggttttttcgttgatggtcgggaactcgtgccaagtatggaagaggacgctgtcttcttcgccgccgccgatgatgtcccacgcttcttcgccggtgaagcacaaaatcggtgcaatcaagagaaccaaactgcgtgtgatgtgatacagggcagtttgtgcgctgcggcgtgcatggctgtctgctttggtggtgtagaggcggtctttcaggatgtcgaggtagaacgcacccaagtcttccgagcagaaagaaacaatgtcttttacggcaaagtggaaggcataacgcggatagtaatcgcctgccagacactcttgcagctgacgtgccaataccacggcgtagcggtcgatttccaccatatccgcctgttgcacggcatcttcaatcggattaaagtcgctcaagttggcaaacaaaaagctcaaggtattgcggatacggcggtagctttcggttacgcgtttgaggatttctttggaaatcgccaattcgccgctgtaatcggtagatgccgcccacaggcgcaggatgtctgcgccgaattcgttataaacctcttgcggtgcaacgacgttgccgatggatttcgacatttttttgccttcgccgtcgacaacgaaaccatgggtcagcagctgtttatacggcgcgcgacccattgatgaggcgcagccggtcagcatggacgattgaaaccagccgcggtgttggtcgctgccttcgagatacaaatcagccggccattccaattcttcgcgttgtttcacaacggaataatgggtcgagccggagtcgaaccatacgtccattgtgtcagaaagtttatcgtaattttcgcaatcttccgcgctcaagagttcgctcttatcgagggagaaccacgcttcgatgcctttttcttcgattttcagggcaactttttccaaaagttcggcagagttcggatgcagctcgcccgtttctttgtgaacaaagaaagtcatcggcgtgccccaatagcgttggcgtgaaaccacccagtcaggacgaccttcaatcatggcttccaaacgcgcgcgaccccaagacgggaagaattcggtgtcgtccacggccttgatggctttgtcgcgcagggttttgccgtcggcaccggctttgtccataccgacaaaccattgacctgtcgcgcggtaaatcagcggcgttttgtgccgccagcagtgggcgtagctgtgttcgattttactgcttgccaaaaggttgccggtttcttccaaccattgcaggatgacggggttcgcctcccaaacgcgcataccggcgacacgcggcgtttcgccgatgtatcggccttcggcgttgacggggttgtaaagctcgatgccgtatttattgcagacggcgtagtcttccaaaccgtgcgcgggggcggtgtgtaccaagccggtaccggcatcggtggtaacgtgttcgccgttgagcatgggaatatcgcgttcgaggaacggatggttcatgtgcagattttccagcttgtcgccggtggtttcggcgagaatagcaatgccgtctgaaaaaccgtaacgtttgagcgcgtcttctgccaaatctttcgccaataccaatttgcctttcggcgtatcaatcagttgatacaccacgtctgcacccgcagacacggcttggctcgccggtagcgtccaaggcgtagtcgtccaaatgacggcaaacgctttgccttcgaaaccagccaaaccgaatgcggcggcaagcgcggcagtgtctttaaacagataggcaacgtcaatcgcgggcgagattttgtctttgtattccacttccgcttcggccagcgaagaaccgcagtccaagcagaattgaaccggtttcgcaccccggtagagatagccggatttgtagatttcgccgagcatacgcacggtatcggcttcggttttgaaatccatagtcaggtaaggatggtcccagtcgcccaacacgcccaagcggataaagtcttttttctgacgggcaatctgttcggcggcgtattcgcggcacaattcgcggaaacgtgctttgggcatatctttgccgtgcagtttttctaccatcacttcgatgggcaggccgtggcagtcccaacccggcacataaggcgcgtcaaaaccggcttgggttttgctgcggataatgatgtctttgagaattttattgacggcatgaccgatgtggatgtcgccgttggcatacggcgggccgtcgtgcagaataaatttcggacggcctttggcgatttcgcgcagtttttggtagcgtttttgctcgtaccagcttttcagccatgcaggctcgcgcttggcaagattgccgcgcatcggaaacgggctctcgagcaggtttacggttttactgtaatcggtcattttttaatctctattgttacaatatttcggtctcagacggcattgcgccccaaacagcatttcacaacgggaaaaccctgtgccgtctgaacagttaaaagattgattgtagcccaatcggatggtttgtataaggtttttctaccaacgccttgcggcttccatatcggcttcaatctgccttttcagttcttccataccgtcaaacttttcctcatcgcgcagtttgtgcaggaagcggacgttcagcccttgtccgtacaggtcgccttgaaagtcgaacaggtggacttcaagcttttgagaacagccgctatcaacggtgggattgaagccgaaactcgccacgccgcgccgcgtgccgaatgcgccgtctgcttcgacgacaaacacgccgccgagtgcataacggtggcggggcaggcggatgttggcagtcggggcgtttaaggtgcgtccgagttttctgccgtgcaccaccctgccgctcaagacgtagtcgtgtcccaaaagttttttcgcataggcaaggttgccgtctgaaagggcttgtcgcacggcggtactgctggtgcggatgtcttcgacgatgacggaaggcgtacgctcggtctgcatatcgggctgttgtgccaaaagttcaaaacagccttcccgccccgcaccgaaacggaaatcatcgccgacgagcaaataacgcgtattcaaggtttgacgcagcaggcggtcgataaacccttgcgcggatatttcggaaaaattttgatcgaaacgcaaaacccagacggcatcgacacagcctgtgccttccaataattcgagcttggtgcgcagggggctgatccgacacggtggcatcctgccggtgcggagtgcgaaaaattctttgggttggggttcgaaaacgacggtcacgacgggcagtccgcgcgcgtcggcttcgaggcggagtttttggaggatgtgtttgtgtccgaggtgtacgccgtcgaaattgcctatggttacggcggcaccctgtggaaagtcgggcgcgttgtgccgccccagcctgattctcattgttgcattcgggtatgtggtgaaacaggcggtcattgtaaacggtattgcggtttatagacagtgtgccgcccgttacgcccgcccgacgcgggaaaagtaggcaaatttcccgccgccgaacgcgccaaacgcacaaaaacgcgcagcaggcgcggtgctatgtgttgaaacatcgccccaaacctgatgcaacatcagtgaaaatcgttcttttttaaccaggtaaaccgagacaaacaaccctccgccgtcattcccgcgcaggcgggaatccggacctgtccgcacagaaacttatcggataaaaacagttgctcaaaccccgagattctagattcccactttcgtgggaatgacggttcagttgcgttccgacaacaccgtaatcttgaaactcgtcattcccgctcaggcgggaatctagaacgtggaatctaagaaaccgttttgcccgataagtttccgtgcggacaggtccggattcccgcctgcgcgggaatgacggcatttctgcggcaatcggattatttccaaaccaaaagcgcgtggttgcgtttgccgcgccgaaggatagtgtatttgccgaaacgtttgtgttcgccgttcagcaggcaggcatcgtcggggcgttcggcggcgtggttggggttgttggcttcggcaggtttgccgttgagcaaaaccgctttgctgttcacaaagccgcgcgcttctttattggaggatgccaaaccggtttttaccaaggcttcgacgacattgatgccgtctgaaacttcaaatgcaggcaggccgtcgagggcgagctgctcgaagtcgctttcggtcaggctgctttggtcttcggcaaacaggctttcggaaatgcgttgcgcggcggcaagggcttcttcgccgtgaatcaggcgggtcatttcttcggcgaggatgcgttgcgcttcgggcttgctgccgcttgccttgtctttggcttcgatggcatcgatttcttcgatggacaggaaggtaaagtatttcaggaatttatacacatcggcatcggcgactttcagccagaattggtagaactgatagggcgaggtttttttcgcgttcagccataccgcgccgccttcggttttgccgaatttggtaccgtctgatttggttaccaaaggcagggtcagaccgaatacttgtttttggtgcaggcggcgggtcaggtcgataccggcggtgatattgccccattggtcggagccgccgatttccaaaaccgcgccgtggcgtttgttcaactcggcgaagtcgtaaccttgcagcagggaataggcgaactcggtgaaggaaatgcctgcgccgtcgcggtcgatgcgctgtttgacggattctttgttcagcatggcgttgacggagaaatgcttgccgatgtcgcgcaggaagtcaaggcagttcatgctgccgaaccagtcggcattgttcgccataatggcggcatttccgccttcaaagctcaagaaaggggttaattggttgcggatactttccacccagccggcaacagtttcggcggaattcaagctgcgttcggcggctttgaagctggggtcgccgatcataccggtcgcgccgcccaccaaagcaatcggcgtatgccccgcctgttggaagcggcgcaatgccaatacgggcagcaggtgtccgatgtgcaggctgtcggcggtcgggtcgaagccgcaataaagggcaattttttgttcgttcaacaaagcgtctaaggcttcgatgtcggtggtttgcgcgataaggccgcgcgattgcaggtcttggatgacgctcatcggtctctttcaaaaaaaattagcgtttttgcaaaccgccgattgtaacaaatttaagcgaatcaatggttatggcgcgtatcgagaaaccgttgtttttcggaaaaacgctttgccaattccgtgccgccgtaagggttgatgtggtctttgtccgagtaaaccggcaatccgccgatttgaaaatctgcggggatataggcggcggcatcaataatatagacgttggggtatttggctgccaattccctgatgcgtgcattggctttcagggtgctttcgtcgtccgggcgcagggcttggcggtaacccggtatgcgtgaagacaagatataggcgcgctggacgttgtaagacgaggcaaggttgtccgccatcaggtaaacggcttgtttttcggacgagagtttatgcagcatacggtcgaatttttggaaaaaaccggcatcataggcaagggagcggctgttttcgggcatttggctgccccagcgcatcgccaaaaccacttttgaataccggggcaggtgttcttcggcatagcgataaacggcgcggcaggctgcccagttttggaacacacgggacgcgtagccttccacataggcgcaagcgtcggcggaaaccatagtggcggaccatttttcttttttgcccacggcatcgaagaatgttttgtaatggtcggcgtgggagtcgcccaaaaccagcagttccggctgtttttccgtatccccccataggcattgtttgccggtattgttgtggcaggaggtgttggaacgcgtcagccccaagcggtcgtattgcgccataaacggcagtctcatcgcaaaaaacgagcccgcccccaaaatgagcataggcaaggcataaatccataaaacggattgtgcgaacgaaccttgccattttttaaacggtttttcgatgcagtggtaagaaaacagggaaagcagcaatatcaggacgaccgccgccgccggcgaataaggcggcaggttgtccgggccgatatagcgcataaaggccaatatcggccaatgccacagataaagcgaataggaaatcaaaccggcggcaacagtgattttcgattggaaaaattttttaagcgggtgttcgtaatgattgaaataaatcagcgcggcaacagccagacagggaatcaaagcggcggggcccgggaaataggcggtttgttccgaataggaaaacaggcaggttgacaatatgcacacggcaaacaatgcgccgacggcggcacagcgtctgccgacggcaggttgccggcagcgcatccacacggcggtcagcgatcctatcagtaattcgcaggcgcgcaggtggggcaggtaatatttatcgagcgcggaaggtataaaggaggcggcaaggcttaaggcacacagtgcggcaaggaagccgaactgtacgcgcaggcttttgcgggcgacaagcagcagcagtatcggaaagacaaagtaaaattgttcttcgaccgacaaagaccagatgtgcagcaggggcttttcttcctgcgcgggatcgaaataatccttcccccttgcaaaatacaggttagaggcgaaacccaaggcggtcagcgcggatttccacaaaagaaagaaatcatctttggtgaataaaaagaagccgcctgccagcgttgccgccaatacggcgaaaaatgcgggcagaatccgcttgatgcggcggatataaaatgccttcagggaaaacctcccccccccccccgacatttcgcggtgaagaatcgtcgtcatcaaaaagcctgaaatcacaaagaatatatcgacaccgagaaacccgcccggcagccaatccttttcgatatggaacacgatgacggacaagacggcggcggcgcgcaatgtgtcgatgtccgggcggtagggtaaggcttggctcataatgtttttatagtggattaacaaaaaccagtacggcgttgcctcgccttgccgtactatctatactgtctgcggtttcgtcgccttgtcctgatttaaagttaatccactatactcgaaacgcggcggcgcaaatgccgtctgaaaggtcatttcgtatcggggatcgggatattcggaatgccggacggcttcccgtaacggcggggcaggcggtttgttttgcaggaatcggggagggcaaatcggaaatgcgggtgggagtttattttgatgcggctgcattccggcggtacgggaaacgccgaaaatcatcaaaatcggcttcagacggcatttccggcaagccgcctgaaacctgccgcatttgggttacacgttaaacaaaaagtgcatcacatcgccgtcttgcacgacatattccttgccttccacacgcattttgccggcttctttggctttggcttcgccgccgagcgagacaaagtcgtcgtaagaaatgacttgggcgcggatgaagccgcgttcaaaatccgtatgaatcacgccggcggcttgcggcgcggtgtcgcctttgtgtatcgtccacgcgcggacttctttcacaccggcggtgaaataggtttgcagccccaagaggtcgtaaccggcacgaatcaggcggttcaggcccggttcttccaagcccatttcggcgaggaactcggctttttcgtcgtcttccaattcggcaatttcgctctccatcgcggcgcaaacggcgacgacgggggcgttttcttttgccgccaattctttcaggcggtcgaggtgcggattgttttcaaaaccgtcttcggcgacgttgcccacatacatcgccggtttggcggtcagcaggaacagcggtttgagcatcgcgcgttcttccgcgtccaaaccgaaggaacgcacgggtttgccttcgtccagatgcggcagcagttttttgcacaaatcgaccagcttttgcgcgtctttgtcgcctgagcgggcgcgtttttcttcgcggacgatggctttttcgacacttgccaggtcggcaagtgccaactctgtgccgatggtttcaatgtcggcaatcggatcgacgcggcctgcaacgtggacgatgttgtcgtcgtcaaagcagcgcacgacattcacaatcgcatcggtttcgcggatgttggcaaggaactggttgcccaagccctcgcctttgctcgcgcctgcaaccaaaccggcaatatcgacaaattcgacgatggcaggctgcattttttgcggattgacgatttttgccaattcggccatacgcggatcggggacttcgacgatgccgacgttgggttcgatggtacagaaaggatagtttgccgcttcgatacccgattgggtcagcgcgttaaaaagggtggatttgccgacgttgggcaaaccgacgatgccgcatttcaaactcatgttttttcctgaaaatagagaaatttaacggcggattatagcataccgccgcccgcgttccgaaaaaatgccgtctgaaacggcttcagacggcatccggtttcagaaaaccgttcagaacaagccgtgaatcacgccttctgcgtccacatcgattttctcggcagccggaactttgggcaggccgggcattttcatcatgttgccgcacagggcgacgatgaaacctgcgcctgcggaaacggtgatgccgcgcacggcgatgcggaagtcttcggggcagcccaacagtttggcgttgtcgctcaaagagtattgggttttcgccatgcagatcggcattttgtccaagcccagtttttccagtgaagcgatttcggcagacgcttccgcgctgaaatcaacatcttccgcgccgtacactttttgggcaatcgcacggattttgtctttgatgcccaactcgacatcgtaggcgaaaccgaagttattggtttgactttcaatggcgttgacgactttgcgcgccaaatccgcgccgcccgcaccacctttgccccacacttcggtcagggaaacttcaacgccgtgttcggcacaggctttttcaatcatcgccaactcggcatcggcgtcggacacgaagcggttgagcgcaacgacgacgggcagtccgaatacgtttttcaggttggaaatgtgtttcagcaggttgggcaaacctttttccaaagcgtctaaattttcttcgccgaggttggcgcgttccacgccgccgttatatttcaacgcgcggacagtcgccacgacaacagccgcatcaggtttcaaaccggcaaggcggcatttgatgtcgcagaatttttccgcgcccaagtccgcgccgaagcctgcttcggttacggcgtaatcggcaaggtgtttcgccagacgggttgcggttacggagttgcagccgtgggcgatgttggcgaacgggccgccgtgtacgaaggcgggcgtgccttcgatggtttgcaccaagttgggcttaatcgcatctttaagcaatgccgccatcgcgccattcgctttcaaatctttggcgtaaacggggctgccgtctttggcgtaggcgacaaggatgttgcccaaacgctctttcaaatcgctgatgtctttggcaagacagaataccgccatcacttcggaagcaacggtaatatcgaaaccgtcaggacgcatcacgccgtcaacgggtttacccatgccgtcgatgatgttgcgcaactggcggtcgttcatatcgaccacgcgccgccacagcacgcgtttggggtcgatgttcaactcgttgccttggtagatatggttgtcgagcatcgcggcaagcagattatttgccgcaccgatggcgtgaaaatctccggtgaagtgcaggttgatgtcttccatcggcaaaacttgggcatagccgccgcctgccgcgccgcctttcacgccgaacaccggccccagagaaggttcgcgcagggcaatcacggcatctttgccgatgtggcgcaacgcgtccgccaaaccgatggttacggtggttttgccttcgcccgccggagtcgggttgatggcggtaaccaaaatcagcctgccctgtttttgcggcagtttgaacgcttcggcaggattgattttcgccttgtaatgaccgtaaggctcaatgttgtcggcattcagaccaagcttggcggcaatttcgccaatcgggcgcatggtggaggattgggcgatttcggcatcggttttgaagctcatgattttcctttagaaatgaggagggacatgccgtctgaaagcatcaggcgacaaacaggtggattgaaaataatatcaggcatattataacgttatccgcaccaaacccgcagtgaaatttttgacgcagcaacaaaaataccgttcatattgttcacaatccaaggagaaaacatgggcagcaacgcatggctgttttgggcattggcatcggcaggcttcgcctcattgaccgctattttcgccaaaatgggtttacagggtatagattccgatttcgccacctttatccgcaccttggtcatccttgccgctttgttattgtttttaacctacaccggcaaatggcagggtgtgaacggctttacggggcgcaactggacattcctcatcctatccggtcttgctaccggcgcatcttggctcgcctattttaaagccctgcaactgggcaacgcctcgcaagtcgcccccatcgacaaattcagcctggtcttggtcgcgctgatggcggtggttttcttggacgaacgcccgaacacgcaggaatggataggcttggggctggtaacggcgggcgtgttggtgctggcgttgaaacgttaaaccgaatccgccataccgtctgaaaccgggtttttacttccaagcccctgcaagggcttgagcctctttcagacggcataccgtgccgacatccagccacaagcccgtatgcttctgaccgctcacgcggttttgccgcatttcgccacgcaatacgggcgcgagtttcgccacactgcccgcttcgattccgtcaaacatttcaggacggtaaatacccacgccgctgaatgtcaatccgttgccgccatttacttccggccgcacgctgctgtcgggcagcagggaaaaatcgccgtcggggttgtgcggcggattttccaccagccacagatgggcggaaatatgttccggcagggacgatgccgtctgaaacgcggcggtaaaatcgatgtcggtcagcacgtcgccgttgaccaccaaaaacggctgcccacccaacagcggcaatgcctgcgcgatgccgcctgccgtttccaaaccgcctgcgggttcgggcgaataggcgatgttcacgccataagccgagccgtcgcccaaagcatcttctatctgccgacccagccaagcgtggttgatgacgatttcggtaaaccccgcctgcttcagacggcataggtgccaaccgattagaggcttacccgccacatcgagcagcggcttcggagtggtatcggtcaaagggcgcatacgctcgccgcgtcctgccgccagtatcatcgctttcatatatctgtccgaatatcagtctaaaaatctaaactgccgtctgaaatacagcagcgcggggcgtttgcacccgcagtttttgatttcgtcgagcctgacgtaaaacacaaaatgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatcccccatgtgcagcagttttgattcaaaaagccgtcggtcggacgtttccgcgcgttacggcgtattacgagttcaacgcatcctcgattttggcaagttctgccaacaggtctttaagcagcagcattttctcgcggcccagcacttcctcgatagcgtcgtagcgttcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttgattgggtaggcattgtttaagtctccaagttatcgaaaatcaaactttcaaaccgtcgggaaagcctgtgggcgtaaattttgatgcaaccgttatataacaaaacgaacatatagcaacaatacgctataaaccgcatcggacgactgggtataaaagactttaattccgataatcctatctaaaaatattttaatagttatatcttaatctatttttcccacaatcacaacaagggattacatcggcaggcgcgtcggctctttcccaaaaaacaaaagccgccgcatccgccgcgcaaggcatatgccgcttgattctctacatagcggaaaatttaataaaaacaaaagttaaccgaaaacatccgcctgaaaaattcgtgcgcgcaagccccaataactgctgattcccgtcgtatagtgaaccattttcccatttttgaccaaaacgacggcaggcgttgcgacaatccgccaagaccttgccaaacccccgtcctcatcgttgacagtcggaaagcccaagccgcgttttgccatatacgccgccacttccgccgaactgccggaacgtaccgccacgccgacgaccggcacgccgtccgccgccaaatcatcgattatcggcgactgataacggcacacgccgcaccagctcccccaaaaatacaccaaaaccgccttatctcggctaaactgtcccaaagtcagccgctgccccgacagcagggtcaaaggccgccctgccgcaccggccggctcttcgggcttgcgtatccaatccaaaaacagcgacaccaataaaaacaccaatgccgtctgaacggcaaatttgatgcccgaaagcagtttctttttcatacgctctctcaaacggtacgcccgcgcaaccggcaggcaaacaaaaagccaagtctcaaaacttggcttccggttatctggtgggtcgtgagcgattcgaacgctcgaccaacggattaaaagtccgctgctctaccgactgagctaacgacccgataagccgtgcattatacagcaccatcctacctcgtcaagcaaattttacaggcttaattgcagaccactgtttgcacgggatattttgacaacggattttcacaatccgccgcataccgtgtaaaagttcgcacaaggaaaagcaaaccgcccgaaatcaatgtacactttccgcccgtttcccttcccaacctgcacacagaaacacacattatgaacatacaaaacatccgcaccctcctcgacaccgtcgccgttccgaatacggcacgcacgctcggcggcgaaaaggccgtccgttcggtcgaacagcgttcagacggcatccatatcgccctgcatttcggcttccccgtcgcgcacattgcctcagaaacagccgaccgcatacaggaaatcctgatgcccgaaacaggcgacacacacatccatctgtccatggacactgaaatcggcacacacaaagtccagcccggcgttaccaccatcaaaggcgtgaaaaacatcatcgccgtcgcatcgggaaaaggcggcgtgggcaaatcgacaaccaccgccaaccttgccgccgcaatggcgcgcatgggcgcgcgcgtcggcgtgctcgatgccgacctttacggcccgagccaaccgaccatgttgggtgtggacgaccgcaaacccgatcagaaaaaccaaaaactcattcccgtcgaatcttcagacggcatacaggtcatgtctatcggctttctcgtcgataccgaccaagccgtcgtctggcgcgggccgatggtcagccaagccttgcagcagctgatgttccaaagcgagtgggacgaagtggactacctgtttatcgacctgccccccggcacgggcgacatccagctcacgctgtcccagcgcatccccgtaaccggttccgtcatcgtaaccacgccgcaggacatcgccctgatagacgcgcgcaaagccgtggatatgttccgcaaagtcaacattcccattttgggcgtattggaaaatatgtccgtccacatctgcaccaactgcggacacagcgaagcactgttcggcacggacggcggcaaagatttcgccgcacgcctcaacgtccccctgctcggacagcttcccctaagcctgcccgtgcgcgaagccatggacggcggcacaccggcgcaactgttcgacgaacaccccgccatcgcccgaatctacaccgatgccgcattccaaatcgccctgagcattgccgacaaaggcaaagacttcagcagccgcttccccaaaatcgtcgtcgaataaagccgcgtccgaaaccgcaacagcaatgccgtcccaagccccgcgcctgccggcgggcaaacttgccggataaaacggtttttttgagattttacgttccggattcccgcctgcgcgggaatgacgaattttaggtttctgattttggttttctgttttgtaggaatgatgaaattttgagttttaggaatttattggaaaaaacagaaaccgctccgccgtcattcccgcgcaggcgggaatctagaccttagaacaacagcaatattcaaaggttagctgaagctttagagattctagattcccactttcgtgggaatgacgggatgtaggttcgtgggaatgacgcggtgcaggtttccgtgcggatggattcgtcattcccgcgtaggcgggaatctagaccattggacagcggcaatattcaaagattatctgaaagtccgagattctagattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagattataaaagacccgtcattcccgcgcaggcgggaatccagaccttagaacaacagtaatattcaaagattataaaagactcgtcattcccgcgcaggcgggaatccagactgtcgggcatctgcagcggtttgctaaaaaacgctttaccgtgatcagtgtgcaaagttaaaatggggaggtaagcttttcaatcagcaatccggcgggcgcgggatcgggcggtttaccgaaccccggtgttcgcggcgcgcctgccgccgacggtatcccgcgaagcaagatttaagggataaaatatgttccaacacgcagggcggcacataaggcgccgccctgattcggaagggcttgcacccctcccggacaaagcctgatcctgccgccccgaaggacggatgcccgaagggcggggggtttgaccgaaaaggaaatacgatgaataaaactttaaaaaggcgggttttccgccataccgcgctttatgccgccatcttgatgttttcccataccggcggggggggggggggcgatggcgcaaacccataaatacgctattatcatgaacgagcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatcaaaccatcgtctctacgacagaaggctcccctatttcccttggcgaccagcagcgcgaacataccgccgtggtctattatctgaacgccaaactgcacctgctggacaaaaaagggattaaagatatcaccggcaaaacagtgcggttgggtgtcttgaagccgagcatcgatgtgaagacacaaaatacggggcttggcggcattctagcttattgggctaggtgggacattaaagataccgggcagattccagtcaagctcggcctgcagcaagtcaaagcaggccgctgcatcaataaaccgaaccccaatcccaacaaaaaagacctttcgccggccctgactgcccccgcgctgtggttcggacctgtgaaagatggtaaggcggagatgtattccgcttcggtttctacctaccccgacagttcgagcagccaaattttcctgcaaaacctttcccgcaaggatgacacaagcaaaccgggccgctattccctcaaacccttgagtacgtcggagattaaaagtaaagagccgagtttcacggggcggcaaaccgtcatccgattggatggcggcgtacggcatatccaactggatagaaacaatgaggccaccggtttaaatggaaatgacggcaaaaacgacactttcggcattattagagaagggagcttcatgcctgatgccagcgagtggaaaaaagtattgctgccttggacggttcggggttttgctgatgacagtaaatttaaagcattcaacaaagaagaaaacaacgacaacaagccaaaatacagccaaagataccgcatccgcgaaaacggcaagcgcgatttgggcgacatcgtcaacagcccgattgtcgcggtcggcgagtatttggctacttccgccaacgacgggatggtgcatatcttcaaaaaaggcaacggggacgcgcgcgactatagtctgaagctcagttatatcccgggcacgatgccgcgcaaggatattcaaaacaccgaatccacccttgccaaagagctgcgcacctttgccgaaaaaggctatgtgggcgaccgctatggcgtggacggcggctttgtcttgcgccgcattacagatgaccaagacaagcaaaaacacttctttatgttcggcgcaatgggctttggcggcagaggcgcatacgccttggatttaagcaaaatcgacaacagcaacccggccggcgtttccatgtttgatgtcaaaaacgacaatggcgtgaaattaggctacaccgtcggtacgccgcaaatcggcaaaacccacaacggcaaatacgccgccttcctcgcctccggttatgcgactaaagacattaacaacggcgagaataaaaccgcgctgtatgtgtatgatttggaaaacaacaacggtacgccgattgcaacaatcaacgtacccgacggcaagggcgggctttcgtcccccacgttggtggataaagatttggacggcacggtcgatatcgcctatgccggcgaccgcggcgggaatatgtaccgctttgatttgagcaacaacgatccgaccaaatggtctgtacgtactatttttaaaggcacgctggataagccgattacctccgcgcccgccgtttccaaactgaaagacaaacgcgtggttatcttcggtacgggcagtgatttgagtgaggatgatgttgataaaaaggatatacaatctatttacggtatttttgacaatgacacaggcacggatgtggcagaagaaggacagggcaaagggttgctcgagcaacaccttactcaggaagataaaaccttattcctgaccgattacaagcgatccgacggctcgggcgacaagggctgggtagtgaaattggaagccggacagcgcgttaccgtcaaaccgaccgtggtattgcgtaccgcctttgtaaccatccgcaaatataacgacggcggctgcggcgcggaaaccgccattttgggcatcaatactgccgacggcggcaagctgaccaagaaaagcgcgcgcccgattgtgccggaagccaatacggctgtcgcgcaatattccggtcataagcaaaccgccaaaggcaaatccatccctataggttgtatgtggaaaaacaatgaaaccgtctgcccgaacggatatgtttacgacaaaccggttaatgtgcgttatctggatgaaaagaaaacagacggattttcaacaacggcagacggcgatgcgggcggcagcggaacattcaaagagggtaaaaaacccgcccgcaataaccggtgcttctccggaaaaggtgtgcgcaccctgctgatgaacgatttggacagcttggatattaccggcccgatgtgcggtatgaaacgaatcagctggcgtgaagtcttcttctgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagacattcaatgctaaggcaatttatcgggaatgactgaaactcaagaaactggattcccactttcgtgggaatgacgggatgcaggttcgtgggaatgacgtggtgcaggttcgtaggaatgacgtggtgcaggtttccgtgcggatggattcgtcattcccgcgcaggcgggaatccagacattcaatgctaaggcaatttatcgggaatgactgaaactcaaaaaactggattcccactttcgtgggaatgacgggattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgatgggattagagtttcaaaatttattctaaatagctgaaacccaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgcaggcgggaatctaggacgtaaaatctcaagaaaccgttgtacccgataagtttctgcgccgacaaacctagattcccgcctgcgcgggaatgacggttcagttgcgtaggactggattgtgaaaaggggcggattcggtgaaaacggcggaaatgtgggattgatggaatcggtgggctgaagccctccctacagagctttcagacggtattgtttgcgttttcgggatgggggcaaatgaaacaccgacaaaccgataccgtcattcccgcgcaggcgggaatctagacattcaatgctaaggcaatttatcggaaatgactgaaactcaaaaaactggattcccactttcgtgggaatgacgattcggacattccttaaactacccgtgtatcgctgtaaatcttagagatggaggaataaagaccgttgggcatctgcagccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgatggttcgggtattcctgacgattcgggtattcctgacgattcgggtattcctgacgattcgggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcgggtattcccatagtttcgccgggcggacgtggggaaatgcgtaacgggcatagtgggcgcggagcgggcggttttatgccccggatttccgttttcgcgcgaacatatcagcccgcctgccgcgtttgcgcttgaaatcgggtatgtttcgtcttaaaatatgctgctttcagggtataggcacttgcccgaaaagcacgttacgcgtctatcttgcgcggcgtgtttttttttgaccggatttttccgaccggatgccccctgccgaagtcccttcagacggcattgtcaagaattttattaaaaacaggattcccatcatgagcacccccgccctcctcgtcctcgctgacggcagcgtatttcacggcacatcaatcggttacgaaggttcgacttccggcgaagtcgtgttcaatacttcgatgaccggctatcaggaaatcctgaccgacccgtcctactgcaaacaaatcgttaccctcacctacccacacatcggcaacaccggcaccaacgccgaagatgaagaaagccgcagcgtttatgccgccggcctgattatccgcgacctgccgctcttgcacagcaacttccgcgcctccgaaagcctgcacgactatctggtacgcaacaaaaccgtcgccatcgccgacatcgacacccgccgcctgaccacgctgttgcgcgaaaaaggcgcgcaaggcggtgcgattctgaccggtgcggatgccacaatcgaaaaagcgcaagaactcatcgccgcgttcggcagcatggtcggaaaagatttggcaaaagaagtttcctgcacggaaacttacgaatggacggaaggcgaatgggcattgggcaagggtttcgttacccctgacgaacagccttaccacgtcgtcgcctacgatttcggcgtgaaaaccaacatcctgcgtatgctcgcctcgcgcggctgccgcctgaccgtcgtccccgcccaaacgagcgcggaagacgtgttggcactcaaccctgacggcgtattcctatccaacggccccggcgaccccgagccttgcacctacgccatcaaagccgtacaaaaactgatagaaagcggcaaaccgatttttggcatttgcttgggacaccagctcatcagcctcgccatcggcgcgaaaaccctgaaaatgcgcttcagccaccacggtgcgaaccaccctgtgcaagatttggacagcggcaaagtcgtcatcaccagccaaaaccacggttttgccgttgatgccgacaccctgcccgctaacgcacgcattacccacaaatccttgtttgacaacactttgcaaggcatcgagctgaccgacaaacctgtgttctgcttccaaggccaccccgaagccagccccggtccgcaagatgtcggctatttgtttgacaaattcattggcaatatgaaagcggcaaaacgggcataatggttttcagacggcaacagtatgctgctgccgtctgaaaaacaaagctggaaatgaagattagcgcactcgaccatctagtactaactgttgccgacattgaccgaaccatcgcgttttatagtgaattaaatttaaaccggtacagcgttggctcgccttgccgtactatttgtactgtctgcggctcgccgccttgtcctgatttttgttaattcactatacacacaagttttgggcatggaagaagtttcatttggcagcgaccgtaaagctttgttgtttggcagtcagaaaatcaacctacacgggcgcggtgcggaaattcagcctaacgcgcaacacgccgcctgcggcacagcggatttatgcctgctgaccgatacgccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttattgattttcagacggcttatgcaaaataaaaaacagcctgcacaagctgttttccttgcagcctctttaaccccaacagccgccccgtcctctctccctgtgggaaagcgttagagagagggcaacaagccgcaaggcttgtgtttgggcggttagggtgttggggaaggttgccgaaattcggggaatgccctctccccggccctcccccacgggggagggagaaggttgcagcagattttgcggttgcaggcggtttgaaaggcaacttagatttgcagctgttgtttcaggtcatctgaaaaataaaaagcagcctgcacaacctgttttccttgcaaaacccttaatcccaaccgccaccacgtcctctctcccatgggagagagtcagagagagggcaacaaactgtaaggcttacacaaacagtaacccgacaacagaatgagcacgcacgagaaacttttaaccgccgacaaccccgtcctgcatcaacgcgccaaagccatgcgccaagaaatgagcgaggcggaagcaaaattgtggcagcacctgcgggcaggccgtctgaacggctataaattccgccgccagcagccgatggggaattatattgttgattttatgtgcgtaacgcccaagctgattgtcgaagcagacggcgggcagcacgcggaacaagccgtatacgaccacgcgcggacggcatatctcaacagcctgggctttaccgtgctgcgtttttggaatcacgaaattttgcagcagacaaacgatgtactggcggaaatcctgcgcgtattgcaggaattggaaaagcagtatgcgcaataacaaacggttaattttgattagagttttgaaaattataggatacaggtagggtacaggctgcttgaattgagcgtttagaagaccgtctgaaaaacaaaaaacagcccgcacaacctgtttttcctgcagaacccttaattccaacagccgccccgtcctctctccctgtgggaaagcgttagagagagggcaacaagccgcaaggcttgtatttaggcggtgaaggcattggggaaggttgccgaaattcggagaattccatctccccagccctcccccacgggggagggggcaggttgcagcggattttgcggttgcaggcggtttgagaaagaatgcccgaaatatcaacagcgggaatttttcaggcagcctttatcgcaaggcaggtggaacaaacgccgcgaacgttttttcagacgacctttgaactcatcggcagagagtgtgccgcaaggcacgcacgcggtgggttggggttgcagggaaaatggagaacgcgtgcatacgtaccgcacataccctacatacgggctacggcttgctacgatacgggggtttcgatatacaagttaggttttagcaaacccaacattttagacaattaagcggtttgtgttgggttttcaacccaacctacgcttgctacgtttattgcaacatattcgcaggagtttaaatatgtcaatacctattaatttcaataatttaaagtatttgcttaatgatatgagaaacaaaaatagaataattgaagcatttccttttaattataatcaaaggcaatacgccgttattttgactaggtataaacctgatgaacctagaccagatgattatgcacaagcaaaattagagttttttaatttgaatagtgaaaattcaatatttgcgtatgctgatttttatgaagttcattttaaaagtgctactgattttattaatttttttaaaattaatgttcaggctggtgctgcgaaaatcagagaaatttttcagagttttagtaatctttttgcagatttcattccaacacaaactaaaaaagatttagacataatttataaaaagattgtagctactcgtttagaacctaattctcctaacactatttattgctatgatgtccgtagaaatgggaaagataaggctggcaagcctaatcgcaggagcgtggaaaatagtgaaaaagcaaaaattttgcgcccagagctatacgaaaaatttaaagccgatagtaattacagttttttcttttcagataatccaagcgatgaaaaaacagatgcagaaataattagagaagttaccaatcgtcaataatccaaattcttcaaaagaaagacccaccatgcccaaacgtaccgacctaaaatccatccttatcatcggcgccggccctatcgttatcggtcaggcctgcgaatttgactattcgggcgcacaggcctgcaaagccttgcgtgaagaaggctataaagtcattttggtgaattccaaccccgccacgattatgaccgaccccgaaatggcggatgttacctacatcgagccgattatgtggcagacggtggaaaaaattattgccaaagagcgtcctgacgcgattctgcctaccatgggtggtcagactgcgctgaactgtgcgctggatttggcgcgcaacggcgtgctggcgaaatacaatgtcgagctgatcggcgcgaccgaagacgccatcgacaaagcagaagaccgtggccgctttaaggaggcgatggagaaaatcggcctctcctgcccgaaatcttttgtctgccacacgatgaacgaagctttggcggcgcaagaacaggtcggcttccctaccctgattcgtccttctttcaccatgggcggttcgggcggcggcattgcctacaataaagacgagtttttggcgatttgcgaacgcggtttcgatgcgtcgcccacgcacgagctgttgattgagcagtccgttctcggctggaaagagtacgagatggaagtggtgcgcgataagaacgacaactgcatcatcatctgctcgattgaaaacttcgacccgatgggcgtgcatacaggcgactcgattacggttgcgccggcgcaaacgctgacggacaaggaatatcaaattatgcgtaatgcttcgctggcggtattgcgcgaaatcggcgtggacacgggcggctcgaacgtgcagtttgcggtgaaccctgcaaacggcgagatgattgtgattgagatgaacccgcgcgtgagccgttcttccgcgttggcttccaaagcaacgggtttcccgattgcgaaggtggcggcgaagctggcggtcggctttacgctggacgagttgcgcaacgacatcaccggcggcaaaacccccgcgtcgttcgagccttccatcgactatgtggttaccaaaatcccgcgtttcgcgtttgaaaaattccctgccgcagacgaccgcctgaccacgcagatgaaatcggtgggcgaagtgatggcgatgggccgcacgattcaagaaagtttccaaaaagccctgcgcggcttggaaacaggcttgtgcggcttcaatccgcgcagtgaagacaaagcggaaatccgccgcgaactggcgaaccccggccccgaacgtatgctgtttgtggcagacgcgttccgcgcgggcttcacgctggaagaaatccacgaaatctgcgccatcgacccttggttcttggcgcaaatcgaagacttgatgaaggaagaaaaagcggtttcagacggcattttgagtgatttggatttcgccgccctacgtcgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatctcgtccttccgaccgcaaaaaagtgatgattctcggtggcggcccgaaccgcatcggtcagggcatcgagtttgactactgctgcgttcacgccgcgctcgccctgcgcgaatcgggctttgaaaccatcatggtcaactgcaaccccgaaactgtgtccaccgacttcgacaccagcgaccgcctgtatttcgagccgctgacgctggaagacgtgttggaaatcgtccgcaccgaaaacccgtggggcgtgattgtgcattacggcggccaaaccccgctcaaactcgccaacgcgctggttgaaaacggcgtgaacatcatcggcacgtccgccgacagcatcgacgccgccgaagaccgcgaacgcttccaaaaagtgttgaacgacttaggcctgcgccaaccgcccaaccgcatcgcccacaacgaagaagaagcgctcgtcaaagccgaagaaatcggctatccgctggtcgtgcgcccgtcttacgtcctcggcggccgcgccatgcaggtcgtccattccgccgaagagctgcaaaaatacatgcgcgaagccgtgcaggtttccgaagacagccccgtgttgctcgacttcttcctgaacaacgcgattgaagtggatgtggactgcgtttcagacggcaaagacgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtacaagacggcgtagtgttcgtattggaagtgaacccgcgcgccagccgcaccgtgcccttcgtctccaaagccaccggcgtgccgctcgccaaagtcggcgcgcgctgcatggcaggcatttccctgaaagaacaaggcgtggaaaaagaagttgtccccgatttctatgccgttaaagaagccgtgttcccattcatcaaattcccgggcgtggatacgattttgggaccggaaatgcgctccaccggcgaagtcatgggcgtgggcgcaagctttggcgaagcctactacaaagcccaactcggcgcgggcgaacgcctcaacccgaccggcaaaatcttcctctccgtgcgcgaagaagacaaagaacgcgtcattaaaaccgctaaaaacttccaagttttaggctacggcatctgcgccacgcgcggcacggcgcaatacctgaccgaacacgggctgattgtgcagaccatcaacaaagtacccgaaggccgcccgcacatcggcgacgcgctgaaaaacggcgaaatcgcactggtcgtgaacaccgtttccagcgatccgcaatccgtgtccgacagccacatcatccgccaaagcgcattgcagcaacgtgtgccgcaatacaccaccaccgccggcggcgaagcgatgagcgaaggcgcgaaaagccgagaccatctgggcgtgtacagcgttcaagaactgcacgggcgtttgaaaaaccgcaactgatgcctgaatcaggttgaaaatgccgtctgaagccgttttgcggtttcagacggcattttgtcatttggaaagccgatgttgccacacacaagccgtacataaggaacagccctatcacgctccccatatagattgccattgccgccgactatacattatcttatttattttttctcaaagttattaagtgagtaaaaacagttttatgacaggtttttatagaattatccacagagattgtttcccagttcctccactaaaaaatccaaaaatacgcgtaagcggagattgacggctttatcgctgtaataaacagcattaaaggggtgtgttttatcggaggtttgttcggcgagcaggggaattaactttccttcagcgatgtcgttgtcaaccaaaaaatctgataagcaaacaataccgcaacctgaaaggcacaacgagcgtaagatttcaccgctgctggcggtaaagtgcggtgaaatcttatagggatttccctgcgcatctaaaaccgcccatgtatttagagaaccgggttcggtgaagcctaaacattggtggccggcaagctcttctgtagattgcggcgtgccgtgttttgccaggtattcaggactggcgattacgcggaagcggctgtcaaacagatggcgtgcacgcagcccggaatcgtccaattctccggcccgtaaggcaatatcgactttgcgttcaatcagattgatatagccttcggaagaaacgagcgaaagtcggatatgcggatagcgttcgttgaattttgctgccagcggcgccagcagatgcagcaccatcggcatcgcggaatccacgctcaacacgccttgcggtatttcgtgcactgccagcatttcggtttccgccgctgccatttcttgcaggattctctgcgcgcggcggaaatattgcgcgccttcttccgtcagactgagttgccgcgtggtgcggttgagcaggttcacacccaacttttcctccagccgtttgacgatgcggcttacggcagaatttgccatcgccaactgctccgccgcacggctgaagctgccgctttccaccacttgaacaaatacggtcagttcttctgaattggttttcatcgtgtttccttttcggttggaaccccgccctttagggcggcaggatcagactttatttgggaggggtgtaaccccttccgaatcaggacggcacacagggcggtgctttatgtgccatcccgtgtgttggaacatctgattatttcatttgacgcaaaagtgttttcttatttttgcacttttaaattataaagtaaaacggcacaatacattcatcaattcacaaacgaggtaacaaatgaatattttattattagacggcggcaaggcgttcggacattctcacggcgggttaaaccgtacgcttcacaaaaaagcgaaagaagttttgaccgcgctcggacacaatgttcaagaaaccgtgattgatgccggctatgatgttgaggcagaaatcgaaaagttcgtttggatggatgctgtgatttggcagatgccgggctggtggatgcacgagccttggacagtgaaaaaatacatagacgaagtattaaccgctggacacggcaaactctaccaaagcgacggcagacacagcgtcaatccgactgagggctacggcacaggcggcttgttgcaaggcaaaaaacatatgatttcactgacttggaatgcgccgattgaagcctttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaaaaatttatcttataaacaaacaaaggcagcctgaaagattgaatggtctgcacccctaaggttggactaaccaaccgactaaggtgcagattattttttgttgctttttcagcttttcgttgggttagatattcttgcccactgttttcaggcagccttgaatacaaaaaaatggcgtatgtaatatgtttatacgaccaaaacggaatgaattttaacgtattgcgcgtcatcaacaatgactgagtttctcgcctctcgcgcctgaatctatagtggattaacaaaaaccagtacagcgttgcctcgccttgccgtactatttgtactgtctgcggcttcgttgccttgtcctgatttaaatttaatccactatatgtcatgcagttcctttcattcaaatcaacaaaagaatgccgtccgaacgtccgttcagacggcacttgtcttcccacaatagacttgaggctgttctaacgtaccaccccttcgttccgccccaaaaccatcgcatcgccgtagctgaagaaacggtattcgcgttcgaccgcatgacgatacgcggcgcggatatgacccatacccgaaaacgcgctgaccaacatcagcagcgtcgatttcggcaaatgaaaattggtaaccagtctgtcgacaacattaaaacggtagcccggcgtgatgaaaatatcggtgtcgccctgccccgctttcagacgacccgtcgcacgcgcggcagattcgagggcgcgcatggaagtcgtgccgaccgcccagactttgttcccccgggcttttgccgcctcaacggcggcggcggtttcagacggcacttcaaaccattcgctgtgcattttgtgctcttcgattttgtccacacgcacgggttggaacgttccggcaccgacgtgcagggttacttctgcggttaccgcgcctttgtctttcagacggtgcaaaagttcttccgtaaaatgcaggcccgccgtcggcgcggcgaccgcgccctgatatttggcataaacggtttgataacggctgtcgtcatccgcatcggcggcgcgttcgatataaggcggcaggggcaggtgtccgttctgttccaaaagttcgtaaacggtctctccgccttcaaaacgcaggcagaacagttcgccctcacgcccgaccgtcacggcgcggatgccgccttcaaacaccagccccataccgggcttgggcgatttggacgaacggatgtgcgccagtgcggtatggttgtccaacacgcgctcaatcagggcttcgatcctgccgccgctgtctttctgcccaaacagccgcgccttcatgactttggtgttgttgaacaccaaaacgtcgcccgcctcgacataatccggcaaatcgccgaacacccggtcttgcagcggcatatcgggcaacgcaaccaaaaggcggctgctgccgcgcacttcgggcggatgctgggcaatcagcttttcgggcagggtaaaatcaaaatctgaaatatccatttttacactctcgttcgggcaagccgccattatacgcactttagccctttttcagacggcatctttgtccgaaaaaccaacagattagaataaacactcttaacctggaacatcttgtgcgcaaaatcaaacttcctgcacatttcccccaaaaaccgccgttttttgatattttactggacatttaccgacaacttcgggaaaataaacacattctcacggtcgttttccaccacaggaaaaccgtatccgaacaccattccgcccggtttgcgccgttgccgcaagccggctgttttctgaaaaaccaacgcaacaacccgccggaacaccggcagcctttaaaggaacagaaatggatttgcgcaaattaaaaaaactgattgatttggttgaagaatcgggtatcgccgaaatcgaagtaaccgaaggcgaggaaaaagtccgcatcacccgaaccatcgccgccgcacccgtttacgccgcgcccgtacctgccgccgcgccggccgtaacgcctgccgccgcacccgttgcggcatccgcgcccgccgccgcacctgccgcccgcgatttgtccgacgcgcaaaaatcgcctatggtcggcacgttctaccgcgcacccggcccgaatgccgcgccttttgtcgaagtcggccaacaagttaaagccggcgacacgctgtgcatcatcgaagcgatgaagctgatgaacgaaatcgaagccgaaaaatccggcacggtcaaagaaattttggtcgaaaacggtacgcccgtcgaattcggcgaaccgctcttcattatcggataatcctgttttcagacggcataaacttccgatgccgtctgaaatgctttcccccttcagcgttcccgcacccttttttacggacgggttgccggaaccgcaggaaaggtcatcatgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcttccgcgcaaagctaccttaacgtccccgccattatcgccgccgccgaagtaagctgcgcggacgctgtccatccgggttacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaagtcggttatcccgtcattatcaaagcctctggcggcggcggcggccgcggtatgcgcgtggtcgagaaaaaagaagacctcctccaatctgtcgaaatgaccaaagccgaagcaggcgcggcattcggcaacccgatggtttacatggaacgctatttgcaacgtccgcgccacgtcgaaatccaagtgattgccgacgaacacggcaacgccatctaccttgccgagcgcgactgttcgctgcaacgccgccaccaaaaagtcatcgaggaagcaccggctccgttcatcactgaaaaagaacgcgccaaaatcggcaacgcctgtgccgatgcctgcaaacgcatcggctaccggggcgcgggtacgtttgagtttttatacgaagacggcgaatttttctttatcgagatgaacacgcgcgttcaggtcgagcatccggttaccgagctcatcaccggcgtggacatcgtgcaggagcaactccgcatcgccgccggcctgcctttgcaatacaaacaaaaggatattcaagtcgaaggccacgcgtttgagtgccgtatcaacgccgaagacccgtacaacttcattccaagcccgggcctgattgaaagctgccacctgcccggcggcttcggtatccgcgtggacagccacatttaccaaggctaccgcatcccaccgtactacgacagcctgatcggcaaaatctgcgtacacggcaaaacgcgtgaacaggcaatggcgaaaatgcgcgtcgcactcgccgagctggcggtaaccggcatcaaaaccaatacgccgcttcaccgcgacctgttcgccgatgcgggtttccaaaaaggcggcgtcagcatccactatttggaacactggctggaagatcgcaaagccaaacaggacaagtaaaccgccgccgatatgccgtctgaagccgcccgtccgcgttcagacggcatttcccttgccccgcgccgtctgaaaccgatttcgatatagtggattaactttaaaccagtacggcgttgcctcgccttagctcaaagagaaagattctctaaggtgctgaagcaccaagtgaatcggttccgtactatttgtactgtctgcggcttcgtcgccttgtcctgatttaaattcaatccactatatttccaagaaagcccgttatgccctaccaacaaatcaccgtcaacgtcaacgatgccgtcgccgaacgcctcgccgacgcgctgatggaacacggcgcactctccgccgccatcgaagatgcctacgccggcacgcaaaacgaacaggcgattttcggcgaacccggtatgcccgccgaacaaatctggcagcagagcaaagtcatcgccctgttcggcgaacacgacgaagccgccgccatcatccaaaccgccacacaagaatgcgggttaaaagacttggcatacaccggcgaaaccatcgaagaccaagactgggtgcgtctcacgcaatcgcaattcgaccccatccggatttccgaccgcctgtggattaccccctcttggcacgaagtccccgaaggcagtgccgtcaacctccgcctcgaccccggactcgccttcggcaccggcagccacccgaccacgcgcctctgcctcaaatggttggatacgcaactcaaaaacggcgaaagcgtcctcgactacggctgcggttcgggcatcctgaccatcgccgccctcaaactcggtgcaggtttcgccgtcggcgtggatattgacgaacaggccgtccgcgccggcaaggacaacgccgcgcaaaacaacgtcgatgcacaattcttcctgcccgacggtctgcctcaagggcaattcgacgtagttgtcgccaacatcctcgccaaccctttgcgtatgcttggcgaaatgctcgccgcccgcaccaaacagggcggacgcatcgtgttgtccggtttgttggacgaacaggccgaagaactcggcggcatttacagccaatggttcgacctcgacccggcggaaaccgaggaaggatgggcgcgattgagcggcgtaaaacgctgaaacggaaaggaaacaccgtgcaggataaaaacaacctctgctggctcgatatggaaatgacggggctgaatcccgaaaccgaccgcattatcgaagtcgcgatgattattaccgactcggatttgaatgtgttggcgcaatccgaagtttacgccgtccaccaaagcgacgacgtgctgaacaaaatggacgaatggaacaccgccacacacggcaggacggggctgacacagcgcgtacgcgaatcgtcgcataccgaagccgaagtcgaacagaaactgctggactttatgtcggaatgggtacccggacgcgccacgccgatgtgcggcaactccatccaccaagaccggcgttttatggtcaaatatatgccgaaactggaaaactacttccactaccgcaacctcgacgtttccacgctgaaagaactcgccaaacgctggaatccgcccgttgccaaaagcgtcgtcaaacgcggttcgcacaaggcattggacgacattttggagagcatcgaagaaatgcgccactaccgcgaacactttctgatttccgccccgagagccgaagcgcaataagaaacaaacaatgccgtctgaaacgcagtttgcatttcagacggcatttttacagcagattgaaatcaaaaatatacacgcccgtcattcccgcacaggcgggaatccggaaggtcgggcctgccgttattttcaatcattacagaaactgaaaggtctggattcccgcctgcgcgggaatgacgggcgtgtgcattcttatagtggattaacaaaaatcaggacaaggcgacgaagccgcaaacagtacaaatagtacgaaaccgattcacttggtgcttcagcaccttagagaatcgttctctttgagctaaggcgaggcaacgccgtactggtttttgttaatccactatacttcaatctgccaaacagatcgaacagagaaaccctgtccgtcaaaacatcattcagccatcgccttgaacacttcaaccgcaaccgcaaccgtttcgtcaatcagctcgggcgtatgcgcggcggaaacgaaacctgcttcataagcggacgggccgaaggcgacattgcggtcgagcatcccgtggaaaaactgtttgaagccttcaatattggaacgcgccatatcggcatagtttcgcggcgcgtgtgcggcgaaatacagaccgaacataccgcccacgctgtcggcggtgaactcgatgcccgccgcatccgctgccgtccgaaaaccttgaaccaactgttcggtacgcgccgtcaggttttcatagaagccttcgcgctggatgatttccagcgttttcaagcctgcggcgacagcaatcgggttgcccgacaaggtgcctgcctgatacacgccgcccagcggggaaatacattccataatgtctttgcgcccgccaaacgcggcaagcggcataccgccgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaggttcatattgccgacgaagggttcgacaatcacgcaggcgatttcattgccgctttgagcaaaggcttcttcgagttgggcgatattgttgtactcgagtaccaaagtgtgtttggtaaagtcggcaggcacaccggcggaagacgggttgccaaacgtcagcagaccgctgccggctttcaccagcaggctgtcggaatgcccgtggtagcagccttcaaacttgatgattttgtcacgcccggtaaaaccgcgtgccagacggatggcggtcatggtcgcttcggtaccggagctgacgaggcgcagccgttcgacggacggcatgattttggcgatttcttcggcaatgacgatttcgccttcggtaggcgcgccgaacgacaaaccgcccaatgcggcttcgcatacggtttcgacgacttcggggtgcgcgtgtccgacaatcgcaggtccccacgagccgacgtaatcggtatagcgcgtgccgttttcgtcccaaacatacgcgccttcggcttttttgataaagcgcggtacgccgccgacgctgccgaatgcgcggacgggggaattcacgccgccggggatgatggctttggcgcggtcgaataaaatttcgttacggttcatatatatcctcaaatgccgtctgaacggcaggtttcgggcttggaagcagaaagccccattttatcatttttcaggttgcgacaaggatttgcccgcttctttgcggatcacgccaaccgcatcccggatgacggaacgctcgtctttttccactttatgtgtaaagcggtagtctcggacgactccctccccgtcgtaatccacacaccactcccaatgtcggcgttctgatttcatataaatgaaattggtcggcaaaaaattataaatcggcaggctgacttcatgataggcataacaaccgaaagggttgcgcttcccgaaacgtgcctctacacctccgcccgggtcgttttgcctttaacaaccgtttgtgcgattccctcttccgtctgatatagtggattaacaaaaatcaggacaaggcgacgaagccgcagacagtacagatagtacggcaaggcgaggcaacgctgtactggtttttgttaatccactataacgcaggaactgatgttccctgtcgccgaaattgctggtacacgcacacagcagcaatgccgcccatacagccggtttcatacacatctcccattaaagccaaacattatacagccgtcccgaccgattaaattcatattttaaaacaatatcctgcctccaaaacccacatcgtgctataatccgcaccgattttcagacggcatcgtcgtgccgtctgaaattttttcattccaacaacaatcagccccgcgattacggctgcctgagaaagacacaaaccatgaaaaaagtatttatccgcaccttcggctgccagatgaacgaatacgacagcgacaaaatgctcgccgtcctcgccgaagaacacggcggcatcgaacaggttacccaagccgacgaagccgacatcatcttgttcaacacctgctccgtgcgcgaaaaagcgcaagaaaaagtcttctccgatttggggcgcgtgcgtccgctcaaagaaaaaaaccccggcctcatcatcggcgttgccggctgcgtcgcctcgcaagaaggcgaaaacatcatcaaacgcgcgccttatgtggacgtggttttcggcccgcaaacgctgcaccgcctgccaaaaatgattgtggacaaagaaaccagcgggctgtcgcaagtcgatatttccttccccgaaatcgaaaaattcgaccacctgccgcccgcccgcgtcgaaggcggcgcggcatttgtatcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaacgcctatcgcggcgaaatggacgacggcgaaatctgcgacttcgccaccctgctgcgcatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcaatgaaacgcggctacaccgctttggaatacaaatccatcatccgcaaactgcgcgccatccgtcctgatttgtgcctgagcagcgatttcatcgtcggcttccccggcgagaccgaacgcgagttcgagcaaaccttgaaactggtgaaagacatcgccttcgacttgagcttcgtgtttatttacagtccgcgccccggcacgcctgccgccaacctgccggacgacacgccgcacgaagaaaaagtgcgccgcctcgaagccttgaacgaagtcatcgaagccgaaaccgcgcgcatcaaccaaaccatggtcggcacggtacaacgctgcctggtcgaaggcatctccaaaaaagaccccgaccaactgcaagcccgtaccgccaacaaccgcgtcgtcaacttcaccggcacgcccgacatgattaaccaaatgatcgatttggaaatcaccgaggcctacaccttctccctgcgcggcaaagttgtcgaagcctaaaccctcacgccgaaaaaatgccgtctgaagcgtttcagacggcattttgccttgtatcggcagacgacggcgcggccgggcggcttaatttgccgcatcccgatccgacagccacgcgcgcacacgccgttccaccgcttcggcactcaagcccaaatcgtctaaaagttttttcggatcgccgtgtccggttacggtatcggcaacgcccaaaagcaaaacgggtttgcagatgccgtgtttcgccaatacttccagcaccgcgccgcctgcgccgccctgttcggcgttttcttcaagggtaacgatgcggtcgtggcttcgggcaaggcggacaatcaactcttcgtctatcggtttgacgaagcgcatatcggcgacggtggcgttcagtttttcggcaaccgccaatgcgggggcgaccatactgccgaaggcaatgaatgcggttttctcaccttcgcggcggataatgcccttgccgatttccacggtttccatgccgtctgaaaccggcgcgcccgtacccgtgccgcgcggatagcggacggcggcgggcgcgtctgcctgatagcaggtcgaaagcaacaggcggcattcgttttcatcgctcggcgcggcgacaatcatgttcggcacgcagcgcaaaaagctcaaatcgtacagaccggcatgggtcgggccgtccgcgccgacgatgcccgcgcggtcgacggcaaacaaaacgggtaggttttgcagggcgatgtcgtgcaccagttggtcgtaggcgcgttgtaaaaaggtggaataaatcgccacgacgggcttcatcccttcgcaagccaaaccgccggcaaaggtaacggcgtgctgctcggcgatgccgacatcgaaatagcggtcggggaatcgttgttcaaactcaaccaagccgctgccctcgcgcatggcgggggtaatcgcaaccagtcgggaatctgccgccgcccggtcgcacagccatttgccgaacacttgggtataggtcggtttggcggcgggcttgggttctttttcagacggcatttgcgccgcgctttctttaggcaggttggcgacggcgtggtatttgacggggtcgttttcggcgagtttgtagccgttgccctttttggtgatgacgtgcagcaactgagggcctttgcggctgcgcaagtctttcaatacgtccaccagattttcgacgttgtgtccgtccacggggccggtgtagcggaagccgaagttttcaaacaaagacagcgactgtttggcgtgttcggcttcttcggcaagggttttgattttgtgttcgactttttgggcaaactccatcgcgccgggtattttgtctaataccttgcccgtttgcgctttgacggtactcaacaggccgtgcatatcgcgcacgacgttgctggcaaggtatttcggcagcgcgccgacgttgggggaaatcgacatttcgttgtcgttgaggacgaccagcaaatccacatccatatcgcctgcgcaattcaaggcttcaaacgcctgccccgccgtcatcgcgccgtcgccgatgatggcgacgctgcggcggtcgctgcccaagagtttgtctgccgccgccatgcccaacgccgcgccgatggaggtggaggaatgccccacgccgaacgcgtcgtactcggactcgcaacgtttcggaaaacccgccaaaccgccatattggcgcatggtgtgcatctggtttttcctgcctgtcaggattttgtgcggatagctttggtgtccgacatcccacaccagcttgtcttcgggcgtgtcgtacacatagtgcagggcgatggtcagttcgaccgcgcccaaattgctggcgaaatgcccgccggtctgcccgacagattccagcagaaaggtgcgcaactcgccggcaaggcgcggcagctgttttttgtccagacggcgcaaatcttgcgggctgtcaatcaggtcgagtagggggcttgggttcatggtgtgtcttttttatgtgtcgtccgggtgcaacggtcaattatatatcaagagcgtgcggctgacggctgattttgccgtatgtcattcgtcctgccgcttggcgcgcgggtgggcttcgtcatacaggcgggcgatgtggtcgaaatcgagcttggtataaatctgcgtggtcgaaaggctgctgtgcccgagcagctcctgcaccgccctgatgtcgcgcgaagcctgcaataggtgtccggcgtagctgtggcgcatcatatgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgcttgcgccctttgccgataacgtgtacccacgcctcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcggccggacagccggcgtaatgcctgtacgaagtcgccgcgagtgcaatttgaagggtttgcagacggcatttcttccagaagggcaagcagttcctgcaagtcgcgccggtatgcggcaaccgtgtgctccgatttaccctcgcgcacgatattttccaaataagcgtccaagtatgccgcaagtccgtccaaacccattcccacacctaaaataacattagaaacattatcataaatcggaatatccgaatcccgaaacgtcaaaacccgacaaacctgcatactggcatcgttaatataaaatcaatgagctgtttatggttttttgctgtaaaaaacattataatccgccttatttacctattgcccaaggagacacaaatggcactcgtatccatgcgccaactgcttgatcatgctgccgaaaacagctacggcctgccggcgttcaacgtcaacaacctcgaacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagaatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgaagcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacttgcgccttgcttctaccggcgcggtacgccgctaccttgccgaaaatccgtccgactttgacccgcgcaaatacctgagcaaaaccattgaggccatgaagcaaatctgcctcgaccgttatcttgcgtttggctgcgaaggtcaggcaggcaaaatcaaacctgtttcgttggaaaaaatggcaagccgttatgccaagggcgaattgaaccaaatcgtcaaataacaggttgcctgtaaacaaaatgccgtctgaaccgccgttcggacgacatttgatttttgcttctttgacctgcctcattgatgcggtatgcaaaaaaagataccataaccaaaatgtttatatattatctattctgcgtatgactaggagtaaacctgtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataaccattgtgaaaatgccgtccgaacacgataatttaccgttcggacggcattttgtattgcaccgtccgacggcatgcccaaggggggaaatccctattttcaggccaaccgctatataatgccgtctgaaccaacgagagaatgccatgcaagctgattttaaccgtcccgtcctggccgtcgataccggtacttcccgtttgtcgctcgcgctgcgtgccgacggcgaaacccgtctgttccatcaggaagtcggcagccgccagtccgaactgattctgccggaaatccgcaccctattccgcgatgcaggcattaccgccgccgatttgggtgcggtcgtgtacgcacagggtcccggcgcgtttaccggactgcgtatcggcatcggtgtagctcagggtttggcaacgccgtttgatacccccttaatcggcgtaccctcgctcgatgccgccgcctcgctgccgccgccgcaaagctgcatccttgccgctacggacgctcgtatgggcgaagtgttttatgcatggttcgatacgctgaactgccaccgtttgagcgattatcaggtcgggcgggcggcagacatccggctgccggagggatgcgccttttcagacggcataggcagcgcgttcgcgctggaagaagctccgccgttctcaggcagaccggatatgccgactgccgccgactttctcgcattggcagccaagggcggttatcctgccgtccatgccgcacacgccggtttgctctacgtccgcaacaaaatcgccctgactgccaaagaacaggccgaacggagagcgcgcccgtgaacatccgccgtgccgtttgtgccgattgtgaggagctggccgcactcgatgccgtctgcaacccgtccgcatggacgcaacgccaatttgagtccgcactggtttcgccgtccgaacaggttttccttgcggaaaaagacggcgggattgccgcctttatcgtttggcagaacctgcccgacgaatccgaactgcacctgattgccaccgcgcccgaatgccgccgccaaggaattgcgtccgccctgctcgaatattggttcacacatctgcccgaagacacgcaacgcctgctgctcgaagtccgtgcaggcaacaccgccgcacaggcactgtacacggcgcacggcttcagcattacgggcaggcggaaaaactattaccgtacagccgacggtaaaaccgaagatgccgtcttaatggagaaaatatgttaagcgcgcgctacctccacctgcacgaagctttgggtttgggtccgatgtggctgaaacaggccgccgccgtcctgccgcccaaaaacacacccgcaccctcggcacaggcacgtccccaaaccgtccgcgccgccccgatccgcccttcccaaccccataacggtcaggcgcggctcgaaacgatgaaagcgttggaaaccgccgccgtacctacgcgcaaacccgcgcctgaaaccgaaacgcctctgcccggcctttcagacggcatcgcccccgttcccgccgcttcgggcatcaccaagcttgccgtcgtcagcctttgcccaccgatcgaggatgcggtttacgggcaactgttccacggcaaagcaggcatcctgctcgacaacatactcaaagccgtaggactggatgccgcctatgtccacaaaacctgttgggtgaaaaccgccgccgtcggcaacccgatgccgtctgaacaggccgtcgcgaatgcgctgggtcaaatcgcccgcgaactcgacggctgccgcgccccggctgtccttttcctcgggcaggcttttgtccagcctgaacggcaaacgatgattgaaactttgtgcggcagccgtcccttcttcatcatcgaccatcccgcccggcttttacgccaacccgaactcaaagcccgcgcctggcaggtgttgaaacagttgaaacgcgccttgcggcaaggcggcggcagttgaagcgcgccgcacggggcggtagaatcgcaactgcgtcccaatatctgacagaaagcacaaaatgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaaaaacaatacggtctgcccgtcgcccccatcgccagcctgaacgatttgtttattctgttgcaaaacaaccccgaattcggacagttcctcgaacccgtccgagcctaccgtcggcagtacggcgtagaataaaaacaaagcatatgccgtccgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggactgtttaaagccaaagaccatctggcaagcacgaaagaacccatattcaacgatttgcccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctgaccgcaacggaaagccgccgcagaaatgccgtctgaaccccgtttcagacggcatttccccgattatatagtggattaaatttaaatcaggacaaggcgacgaagccgcagacagtacaaatagtacggcaaggcgaggcaacgctgtactggtttaaatttaatccactataaagacctgcccaaccctcaaggaccccgatgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaagggcgggggagcggcactgccgccgcgaatgaaaaaaggtcgtctgaaactgctttttcagacgaccttttttaatggttgtttcaaatcaaaatatctatgccgccggccccatcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataatcgggcggagagttccagcgcggcggcttcgtcggcaagcaggccgaagccgtccgattcgaacgggcgttgcagcagtgggcaggccgccgccgtcagtgccgctgcgttttgcgccagccgttgcagggcgaatcggcctattgtttgcggcgaaaacaggcgttcgtccagcaagccttcgtcgtgccagcggcgcagtttttccagcgaaaaatccaaatgcagcgcgcacatgccgctgttgtcgggcagcagggtttcggatacgtccgccaaatcgccgcgtaccagtcagatttcgccggcagatgggcggtattccctgccgcccatttgtaaccggttctgccccgacaccatgacgaacaaggcgcagttgtggctgaaattgtggatttcggtgggaaacgcgcccgttccgccgccgcgcatccgcgacaaggtgatgcccgaatcgaagcggttgatgcacatttccagatgcaaaccgggctgttttgcctgcgcaatgagcgcgctgtcggaacagccgtccaacgcccagccggatttatcggagcggacataggtttggtactggcggtagatggcggcggtgttcatgattggataggaacgagttgtctaacaaatgaattaaataggaattattaccaataatcaagcgcagggattggttgaaacggaaaaggtcgtctgaaagggtgtttcagacgaccttttccgtatcgggaatttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtagggagtcgtctgaaaacggagcttccgaaggaagcggggggtttctgcgaagctaaagtgcggtttcaacgaattgaaaagcagcctgtatgttgaaaataccgctcaagcaaacctacggtttgccgccctctccctagccctctcccacagggagaggggattgggttgcaggctgcctttaaggtttaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgcttccgttacaactccgcccactgaaagcagcctgcaacgaagccaaaacgacaaaccgcatcgtaaaccacccaacccataggagaaccccatgcaaaacgaaaccatcaacctgaaacagcaccttgccgccatcaaagaatactggcagcccgaaatcatcaaccgccacgggttccaattccacttggtcaaacttttgggcgattacggctggcatacgcacggatacagcgacaaagtgctgtttgccgtggagggcgacatggcggtggacttcgccgacggcggcagcatgacgatacgcgagggcgagatggcggtcgtgccgaagtcggtgtcgcaccgcccgcgttcggaaaacggctgctcgttggtgctgattgagttgtccgacccgtccgaggccgtctgaaaacgaagtttccgaaggaagctgagtttctgcgaagctaaaagcagcctgcaccttcaatcaatatgccgaaaatacaaccccaccgcacaccaacacacaaaggaaatcccatgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataaggtcgtctgaaaacggagtttctgcgaagctatagtggattaacaaaaaccagtacggtgttgcctcgccttagctcaaagagaacgattctctaaggtgctcaagcaccaagtgaatcggttccgtactatttgtactgtctgcggcttcgtcgccttgtcctgatttttgttaatccactataaaagcagcctgcacattgaaaatgccgcccaagcaaactttcagtttgcccgcctcgtcctagccctctcccacgggagaggggattggggtgcaggctgcctttaaggttcaggcaaattttaacttcgttgataccgcgctttagcttcgcagaagctgcactttcagacgaccttttggaacaccacaggtacacgcatttaaggaatgccgtctgaaatgcctgcctcaataacgcatcatgttgccgtcaatctcggccgcccatgcatcgatgccgccctgaaggttgtacaggttttcaaaacccgcgtccgccaaatacatcgccgtatgcaggctgcggataccgtggtggcaatacaccacaagcggcacatcatccggcagctcgttctgccgcagcggaatcagattcatcgggatatgcagcgcatttggcagcgaacaaaccgccgtttcttcatccgtacgcacgtccaacaaacaaaacatccgcccttcgtccatccacgctttcaattccgcgggcccaagttgcacaatatccatcgcaccccccaaaaaaaaccaagcaaaatgccgtctgaagccccaaacccgctttcagacggcatgacctgtcaacatcttaaaaatcgaaaccgccaaacggatcggcatccttatcatccaaatgcgccaccaaggtatcgaacagcaccttctcttcaaacacatcgcccctgcgcgtaatcaaaagcgcgcgttgaacaggcttgcgacctacgataaccaccatgcgtccgccatctttcaactgttctttcaacacttcaggcacaaggtttaccgcaccgccgacataaaccgcatcaaacggcgcacctgcggaaagttcggtcaacccgttgttttgcacataatcgatattgtccaaacccaagccgtccaacaccgctttggcgcggttttgctgttcgacatcgatgtcgtccgacaccacacgaccagccaattttgccaacagcgcggtcgcatagcccgaacccgtgccgatttccaaaaccgtatcgtttttcgtcagcttcaagccctgcgccagccgcgccacgactttcggctcgagcatcttatgaccgttggcaagcggcagcgccatatccgcatacgccaaaccctgcaagtcctcatcgacaaaaagctcgcgcggaatctccgccaaagcgtccaacacatcaaaatccaatacatcccacggacggatttgctgttcgaccatattgaaccgcgctttttcaaaatccatttagtgctccgtcaaataattgttccaacaatggcaggcattataaaaccacactcccgccgcgccaacttcggcacgcgccgacagcccgttttgtcagtctcaaaccgcctgacgcgaagcctcaaaccgcttctccaaaatcttcgccagttcgcccaaatacaaagcatccgtctcatcaaactgcgccaaatgttcgctgtccgcgtccaacacgccgatacagcggccgtctgaaaacagcggcacgacaatctccgaacgtgacaaagacgaacaggcaatatggtcgggatgcgcgttgacatccttaacaaccaccgtttcacccttcgcccaagcctgaccgcacaccccgcgaccgaacggaatccgcgtacacgccaaaggcccctgaaacggtgccaaaaccaattcgtccgaacgcgtatcgaccaaataaaaacccacccaaaaccaaccgaacgcctccttcaaaaccgccgccgtgttcgccaaattcgccacccaatccgcctcgtcagccaccacagactcaatctgcggcaacacctcccgataaagcgcggccttgtccgaagccgaaaaatgaagcgcgtgcatcacatctcctatagttgcatacatatcaggcggccattataaaacagcctgcccgaaacaacattccaaaccgcccggccggccgcttcaagttgcgaacccgccgcatatccactaaacttcacgttgcaccgcgccacacgcggcagacaaaaaaacacgacacggagcaaaaaagatgtatcgccaaatcggaatgtgggatcaaaaatgggtcatcggcaactggaaaatgaacggccggctccaaaacaacaacgcactgatgcaccgcttccgcatccaccccaccgccgaacgcgtcctcatcggactcgccgccccgaccgtttacctgctgcaactgcacaacgccatgcaaatcgttttaaacaaccgcatcctcacctgcgcccaagacgtgagccgcttccccaataacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaagggctggataccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacggcgcactcgtcggcggcgcgtcattgtcgtacgactcctttaccgccatcatcagtgccgcacaaaatgcgtagaaaaatatggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtgaaattggtagacacgctatcttgagggggtagtggccgtaggctgtgcgagttcaaatctcgctgtcggcaccaacacacaaaaacgcctgaaaatttcaggcgttttttgttcaatcccatccaacgctgtcaaccaattccaatcaatacaaggatttcaggctgattgttatcctgccgtcccccttcctgacagtgcaatcccgtccaatccgccctaattgaagtaacctaaaatttacggtatcttttgcggtatctgaaaaatacctcgaaaaaataccgcaaaaataaagctgaacgaccgccaaatcaggaatgccaagcggaaaagagcttgcggggaatactgccaagacgtagggaacaagggggaaaccgtccaagatgcagggcggttttttttgggtttttggaaaaaacctatactaggaagcgatacccttagttgttaccttgttaccggggaaaagttagataaataagcatatgaaatatagtgaattaaatttaaatcaggacaaggcggcgagccgcagacagtacaaatagtacggcaaggcgagccaacgctgtaccggtttaaatttaattcactataaaataagaaaaagataaaaaattggtaacaaatgcggtaacaaatggtaacgaatcggtaacaacttttggggttttccggtttttcaccgtcttggcagtgggagcgtagcggaatgaaaagccaaaacgcacggaaccgcgcctattttgagcaggaatggcggttaaaccgcttggttatatacggggaataggaagacagcgaaacgcgctaaaaacgcaatttgagccattaaaagcgattgattaaaaaaataatcaggttagccgccagtgtttcaggcggcataaacggagaaattgcggggcataaaaaaggcagcttgccgtgttgtctgtctctggtataattccaagtatcactaatcaacggctacacaatgcggatattcaaaaaccaatggatagtgaaatttgccaagaagcacaaaatcaacgattccgagctgctggaagcggtagagcgggcggataacgggctgatagacgcagatttaggcggcggtgtgattaagcagcgcatagcaaggcaaggacaaggcagaagcggcggttatcgcagtctgatactgttcaaacaggcagacaaggcattttttgtttacgcctttgccaagaacgacagggaaaacatttcggataaagaacttgacgtttaccgaaaagccgccgcatattatctgaaatacacgcgggcagagctggcggctttgaaagaagacggcattatcacggagatagaatcatgaaatacaaaaacgaggcattagccgccattcatgaaatgatggaaggggcttacaacatcggcgcaatcgacaaaaagaccatgcgcgactttgacaagtcctgcctgaccgaaatcaaaccgttgagcggcggagacatcaaggcaatcagggagaaggaggcactatcgcaagccgctttcgccatctatctcaacgtgggaaaaaatcacgtttcggcttgggagcggggcgttaaaaagccgagcggcgcggcgttgaagctgctgaccatcgtcaaaaacaagggcatcgaagccattgcgtagccgacttggcaaacggcaaaatcagcaagttcacaatagacgcgctgctgaatatgcctgccaagacaggcaagaccgccgaactgaatatcagggcgtagccgcataaatgcccgaccgcatcaaaccaagccgaaacggcggcggtgcagacgacatagcccgacagcaaggcacggcgcagacgggcgcgaaacccgaaacatcaccgaccgcgaggtacggggattttttgcgcccgttgcagggggggattggatttaagcggcgcgggcttgaaggcaaaacgggtggggcacagaactgtttaaatgcagtctgaatctcaaacgatttcagacggcattttgaaacaatggctcaaattctcgatccccttcccttaacgccgacgttttttattaacgcgccccttatttctgacactttgctcataaaccggcataacggtcggcaacaaccgttttagattttctatacgggcattgtttgtcggatgagtagaggtaatagcataaataaagccgttttggtcgttttcctgattcattttttcccaaaccctgacagcggccgccggatgatagcctgcctgcgccatcaacatcattcccccctcatcggcttcttcttccaagctgcggctataaggcaaggtaagaccgtacgtccccaaaatatccatacccaatccgaccaattccggattagtatccggttttttgtctaatataatctgcgtgcctatctgcgccgccgtattggtcaagatttgctgcccgaccttatttttaccgtgttcatgcagggcgtgcgtcatttcatgccccataatggcggcaatttcgtcatcggtcagcttgagtttgtcgactatccccgtataaaacgccatttttccaccgggcattgcccacgcgttcagctcatcgtttttgaaaaccgtcattttccagtcaaacttatggctggtattatttgccgcatcggcataaggcagcatacgtcgaaatactgcctgcaccctgcgggctgttctggatgtggtatcgacattgccggcagacttgtttaactcaaccgttttcatataatctttggcagccgcagcgttcattgtggcggaatcatgaccgtaaacatcagcaacgaccgcacaagcccccaataccgagattactgccgacaggcagagtatccgtttaaaggaaggaaggaaggaaatttcatatttaggtttactccttaaaaaattaaatttcaaaaaaatgccgtctgaatccaaaacggatttcggacggcatcttaacattgtttaatgtttttaaaaagatttacaccacgatgttctccagtctgcccggtacggcgatgattttcttggcaggcttgccttctatgaatttcaccgcgccttcagcggcgtattcggcagcttcttcagccggtttgtcgaaatcacgcataaattgccaataattctccaacttttttacggctgctgctgccttttgcggcaatattgcgctgaacttcaactgttttcaaaatggcagaagaataaatatcccttgtgaattcagtatcatgatttgaaatcaaaataccttgggagttgggcgcaatttattgattttttgtaaagtccgcgaccaatgaattcgatcgtattttggtcgcgcagaatttgcaactgttggcggattttgtctctgatatggttgttttggggaaattggatggatagtttgttttcaaattcatacatttgcgacaatgtgaattcttcggggagttggtcgatacatttcataacagccagaagccagcctttgcgctccgcattttggttgcgtaaaaacaaattggattgccattttttcagaacggtttcgggttcgataatgcgggaattgtctattaagaatattttgccgctttcaggcaaaggggcgagattgatagaacacataatgtggttcggccggtttttaatgcctttatttctgggaataatcatatccggcgtgatgaaatgtttgggtacaagcaccaattgccgtatggagtaatccgcttttttatatgcaagaaagaaaaagttggggttggtatctgaccggatgcgctccaacatggtgtgatatgcaccgtcaggcacgctgttgcctatggttttttgatttttactctttaattcatattgctcgtggcaatttgggcaaaagaggtctgcaacaggtttgttattggcaaatctctgcatcggcttgcttccgcaacaggggcagtagccgtttttttccaaccaagcctcgctcattacacggattttatgggttgctttattttgttgctttcccaattcggtatcgaaaaataaattcatgttttggattttgagatttcagttattcggggttcgtcatgcagacaacacaatccaccttaaaaaggccgtctgaaaccctgtttccaagtttcagacggcctttatccgtgtggctaaaccttaaaagcggttagacgacgatgttcaccagtctgcccggtacgacgatgattttcttcgccggtttgccttccatgaatttcaccgcgccttcggtggcgagtgcggcggcttcgaggtcggctttggatgcgtcggcggcaacagtgattttgccgcgcagtttgccgttgacttgaaccatcacttcgatttcggatttgaccaaggcggcttcgtcgactgtcggccagcctgcttcccacagtttcgcgccgttcaattcgctccacagggtttcgcagatgtgcggcacgatgggccacaacaggcgtacggcggtttccaatacttcttgggcgacggcgcgtccttgttcgccgccggtgtcggttttgtcgtattggttgagcaattccatcacggcggcgatggcggtgttgaactgctggcggcggccgtagtcgtcgctgactttggcagtggtcgcgtgcagtttgtggcgcaggtctttgagttctttagacaaaccgtcttggctgcctgcgaacgctttgaccgcttcgccttgcttcaagtattcgtaaacggtacgccacaggcggcgcaggaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaggacggcggaaatggggcggcctttgtcgtcgaacgtcagctcgacatcggcggggttgatccaatctttgccgcctttgtcgttttcgcggtagtaggtttcgcaaacgaccatgccttgcgtcagcaggcgttcaaacggttcgtcaacattgactagaccttcgtcgcgcatcagtttggtgaagaaacgcgcgtacaagaggtgcaaaatcgcgtgttcgatgccgccgatgtattggtcgaccgcgccccagtatttcgcggcggcaggatcgaccatgccgtctgaaaattttggcgacatgtagcggaagaaataccagctcgattccatgaaggtgtccatggtgtcggtttcgcgtttcgccgcgccgccgcagcatgggcaggcagtttcgtaaaactcgggcatttttgccagcggcgaacccatgccgtcgggtacgacgttttcaggcaaaacgaccggcaattggtcggcagggacgggtacgtcgccgcattgttcgcaatggacgatgggaatcgggcagccccagtagcgttggcgcgaaatgccccagtcgcgcaggcggtattgggttttcggttcgcccgcgccttggctttgcagcttggcggcgacggcgtcgaatgccgtctgaaaatccaagccgtccaagtcgccgctgttgaccaatacgccgttttctttgtcgccgtaccattcttgccattggttttcgtcaaatgcgttgtcgccgacggcaatgacttgttttttcggcagattgtatttggtggcgaactcaaaatcgcgttcgtcgtgcgccggaaccgccatcaccgcgccgtcgccgtagccccacaatacatagttggcaatccacacttccagcttgtcgccgttgagcgggttgacgacgtagcggccggtcggcacgccttttttctccatcgtcgccatatcggcttcggcaaccgaaccggctttgcattcggcaataaatgcctgcaattcgggtttgtcggcggctgcggcggctgccagcggatgctcggcggcaacggcaacataagtcgcacccatcagcgtgtcggggcgggtggtataaacttgcaggaatttcgcgtaatcgccttccaagccttgtttgctgtcgtctgaaacggcgaagcgcacggtcataccgcgcgatttgccgatccagttgcgctgcatggttttgacttgttccggccagtgttccagcttgtccaagtcgttgagcagctcttcggcgtaatccgtgattttgaagtaatacatcgggatttcgcgtttttcgatcaatgcgccggaacgccagccgcgtccgtcgatgacttgctcgttggcaaggacggtttggtcgacagggtcccagtttaccgtgccgtttttgcgataaacgatgcctttttcaaacagcttggtaaacagccattgttcccagcggtagtattcgggtttgcaggttgcggtttcgcgcgcccagtcaatcgcaaaacctaggcttttgagctgggttttcatgtattcgatgttatcgtacgtccaagcggcaggggcgacgttgtttttcatcgccgcgttttccgccggcatgccgaacgcgtcccaacccataggctgcatgacgttgaagccgtttaaaagtttgaagcggctcaatacatcgccgatggtgtagttgcgcacatgccccatgtgcagcttgccgctgggataggggaacatggagaggcaataatatttgggtttggaagcgtcttcggagacgttgaaaatacgggcgtcgtcccattttttctgcgccgcaggctcaatggcggcgggccggtattgttcttgcatagtcattctgttttcgcttaaaaacgttggaaaaataaagtcggcatcaattataacaggttgccggaagcggcgaatcggcagattgccggcaggatgcgtaaattcgcacgcgcattattccgtatgccgtacaaatacaccgcgtttattgatacgcacgttttttatgctaatattacaaaccaaaatcaaatgtttaaaactctcctgatgcggctcttccgaacaaaaggcagacgggcatcgggtaaaagaggattctgcatatgaaaatcaaacaaatcgtcaaaccgggcttggcagtattggcggcgggcgttctgtctgcctgcgcaaccaaaagcaacgtcaaagccgacggcacgaccgacaatccggttttcccgaaaccctattccgtaacgctcgacaacaagcgcggcacattcccgacttatgacgaactggatcagatgcgccccggcctgaccaaagacgacatctacaaaatcctgggccgcccgcattacgacgaaagtatgtacggcgtgcgcgaatgggattacctgttccacttccataccccgggcgtaggtatcgaccctgaaaacacttccggcgtagaagatgttactacctgccaatacaaagtgattttcgataaagacaaatttgcccgcagcttctactggaaccccgtcttcccgaaagatgccgcctgtccgccgcccgcacccaaagccgagccgcaagtcatcatccgcgaaatcgtgccggcaaaaccgaaacgtatccgccaataatccgacatgccgttccgcctgtttttagggatattatgcggcctgtcaatggttgcccccgtatatgcacaggggcagccggatacggtcggcgactttatccaaaagaaaaaagtcatcgtcgatacatccaaagcggaactctgtttcgctgacgaccgtcagtgccaccccgtcctcatcggtgttgccacgcccaaggggacgttcgggctgacgctgaacagtaccgacaagcccggatacggcggcgaagtcatcggtttcaagcaggagggtgattttcttttcgccctgcaccgcgtttggaatcagataccgtcggaaaggcggaacgaacgcatcgcctccccgtccgtgtccgacaggattatgaccaacggctgcatcaacgtcagcgatgcggtgtacgaaaaactgcgtcattattttgtgttggaagtgatttgaaacagacggataccgcacgcgccggtatctgttttcacattgccccgatgcctgaaacagactgtccgccacgtcatgccgtctgaaaccggcgcagatgccgccaagccttcagacggcattgcctgcccgctccgaccgaacaacaaccatctttgggagaaccttatgcccgaacaaaaccgcatcctctgccgcgaactgagcttgctggcattcaaccgccgcgtgttggcgcaggcggaagaccaaaacgtcccccttttggaacgcctgcgcttcctgtgcatcgtttcatccaacctcgacgagtttttcgaagtccgtatggcgtggctgaagcgcgaacacaaacgctgcccgcagcgcaggctggacaacggcaaaatgccgtctgaaaccatcgccgacgttaccgaagcggcgcgctccctgatacggcaccagtacgacctgttcaacaacgtccttcagcccgagctggcacaagaaggcatccatttttaccgccgccgaaattggacagacacacagaaaaaatggattgaagactatttcgaccgcgaattgctgccgatcctgacccccatcggactcgacccttcccaccccttcccgcgcccgctgaacaaatcgctcaacttcgccgtcgaactcgacggcacagacgcgttcggcaggccttcggggatggcgattgtgcaggcaccacgcatcctgccgcgcgttgttcccctgccgtccgaactgtgtggcggcggacacggcttcgtcttcctctcctccatcctgcacgcccacgtcggaaaactcttcccgggcatgaacgtcaaaggctgccaccagttccgcctgacgcgcgacagcgacttgaccgttgacgaagaagacctgcaaaacctccgcgccgccattcaaaacgagttgcacgaccgcgaatacggcgacggcgtgcggctcgaagtcgccgacacctgtcccgcctacatccgcgactttctgctcgcgcaattcaaactgaccgccgccgaactctatcaggtcaaaggcccggtcaacctcgtgcgcctcaacgccgtccccgacctagtcaaccgccccgatttgaaatttcccacacacacgccgggcagactgaaagccttgggcaaaaccgcgtccatattcgatttggtgcgccaatcgcccatcctgctgcaccacccctaccaatcgttcgaccccgttgtcgaaatgatgcgcgaagccgccgccgaccccgccgtgcttgccgtcaaaatgacgatttaccgcaccggcacgcgttccgaactcgtccgcgccctgatgaaggcggcactcgccggcaaacaagtaaccgtcgtcgtcgaactgatggcgcgttttgacgaagccaacaacgtcaactgggcgaagcagctcgaagaggcgggcgcgcacgtcgtgtacggcgtgttcggctacaaagtccacgccaaaatggcactggtcatccgccgcgaagacggcgtgctcaaacgttacgcccatctcggcacgggcaactaccaccaaggcacatcgcgcatctacaccgacttcggcctcattaccgccgacgaacaaatcaccgccgatgtgaacatattgtttatggaaatcacaggtttgggcaaacccgggcggctgaacaaactctaccaaagtccgtttaccctgcacaaaatggttatcgaccgcatcgcacgcgaaaccgaacacgcaaaagccggcaaaccggcgcggattaccgccaagatgaattcgctcatcgaaccgaccgtcatcgaagccctgtatcgggcaagcgcggcaggcgtacaaatcgatttgattgtgcgcggtatgtgcaccttgcgcccgggtgtaaaaggcttgtccgaaaacatccgcgtccgctccatcgtcggcaggcagctcgaacacgcgcgcgtgtattacttccataacaacggcacggacgatacctttatctccagcgcggattggatggggcgcaacttcttccgccgcatcgaaaccgccacgccgattaccgcgcccgaactcaaaaagcgcgttatacatgaaggactgaccatggcactggacgacaacacccacgcgtggctgatgcagcccgacggcggctatatccgcgccgcacctgccgagggcgaatccgaagccgacctgcaaaacgatttgtggacactgctcggaggctgacccgcaccgccccaatcaaaaaccatgccgtctgaaacctttccgtttcagacggcatggttttacagcaatctaaacagggcggaccggagtcaaaaacacaccttcgccattcctgcacaagcacttcccctatacgctcccaaccccaagccgccgcattccagacggcattatagtggattaaattttaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaagaagaaaatcatgccggacagcattgtttataccgatagtctgagcagctgcgacaagttggacgtgagcggttttatccattaccgcatcaaccattccaaggagtttgcagaccgtcagaaccacattaacggcattgagaatttttggaatcaggcaaaacgcgtcttgcgaaaattatagtggattaacaaaaatcaggacaaggcgacgaagccgcagacagtacaaatagtacgaaaccgattcacttggtgcttcagcaccttagagaatcgttctctttgagctaaggcgaggcaacgccgtactggtttttgttcatccactatacctttccgacagccgaacaaaaccccgaatccgtctgcacggttcggggtatatctccaatacgggcatcgtgttccggaaaaccgtcaaatccgcatcggcatcacaatatatttgaaattcggattgttcggcacggtaaacagcgtcgagcggttggcatcgccgaaggcaagctgcatatcgtcggaatggatgttgcgcaacacgtccatcagatagccgatattgaaaccgacttcgagttcgccgccctgataggcgatttcgatttcttcgcgcgcttcttcctgctcgttgttgctgcacacaacgctcaacaggccgggttgcaaaaacaatcgcgcaccgcggaatttttcattggcaagaatcgatgcacgttccaacgcgcccaacaattctgccctcgacaacacgaaaatcttgtcgttgtccaaaggaatcacgcggttgaaatcggggaatttgccgtcgatgaccttgctgacgatggtcgtgccgttgcattggaaacgcacctgtttgtccagcagctcgatttgaatcggatcgtcggggttgttcaacagtttgaacagttccagcaccgttttgcgcggcaaaatcacttcggcgcgcggcaaatccgcatcaatcgcgcaggctgcataggcaaggcggtgtccgtcggtcgccacaaggcgcaactggctgccctcaacctgcatcagcagaccgttgagataatagcggatgtcctgcaccgccatgctgtactgcacttgcgacagcatggttttgaaacgctcctgctccagcgagaaagtcgcgctgatgtcctcgccgacattcatcatcggaaaatcggcggcaggcagggtctgcagggcaaaacgcgatttgcccgccttcagcgtcagacggctgtcgtcccaatccagcgacaccagcgcaccggcaggcagcgcgcgcaaaatatcctgaaatttcttggcattggtggtgatgcggaagtcgcccgcgccgccctcgggacccgcagtgtcgatttggatttccaaatcggttgccaagagtttggtctgaccgccttttccctcaatcaggacgttggacaggatgggcagggtgtggcggcgttcgacgatgccggtaacggcttgcaacggcttgagcaggctgtcgcgctcggcttgtaaaatcaacatgttcgctcctttaaatcggtttgtatagtggattaaatttaaatcaggacaaggcgacgaagccgcagacggtacaaatagtacggaaccgattcacttggtgcttcagcaccttagagaatcgttctctttgagctaaggcgaggcaacgccgtactggtttaaagttaatccgctatatctttacccttcggacggcatgggcaatatcatgtcgtctgaaaacgttttccatcagttttgaatcagaatcagcagcttttcataatcctgagccaattccggatcttcttcgcgcagtttcgccactgccctgatgccgtgcataacggtcgtatggtcgcgcccaccaaacgaatcgccgatagacggcaggctcaaagtagtcagttctttggtcaggctcatcgccacctggcgcggacgggcaatgtttcgtgtccgtttcttaccgagcacatcgctgattttgatgcggtaatatttcgccaccgcatcgatgatgatgtcggcggtgatgactttgtgcttctcggcaataatgtcctgcaaagcggtacgcgccaaatcgatgtcgatgacgggacggttcataaagcggctgctcgctccgacacgattaaacgcgccttcaagctcgcgcacgttggaacggatcagattggcaatgaacagcgcggcttcgtcttcgatactgatgcccgccgcttccgcctttttctgcaaaatggcgatgcgcatttccaattcgggcggctcgagttccaaagtcagtccccatgaaaaacgggatttgaggcggtcgtccatgccttcgattttcgcaggcaacacatcgcaagtgaggatgagctgttttttctcgttgtggaaatggttgtacagatagaaaaactcttccatcgtacggtctttgcctttgatgaactggatgtcgtcgataatcagcaggtcgtattgcttgtattgctgcttgaacacgtcgtaagtgttgttgcgaaccgccttcataaagctgcggatatagtcatccgaatgcatatagcgcactttggcatcgggacggtttttcagcagctcgttgccgaccgcctgcacaaggtgggttttgcccaaacccgtgctgccatagaggaagaacgggttgtaactctgccccgggctttccgcaatcgcctgcgccgcagccgccgcaaggcggttgcccttaccttctaccaacgtatcaaacgtgtaatccggagacaggttggtctgctcgtaacgcgcctcttccgcatcgcgctgcacgtccgtccgtgctttggcaactgccaccgattccggccgggaagcagacccggcagcctgacgcggctcgtgcggcaggtttttcatacgttccgccaaaatatccgccgccgttttcgacgcagcgggtttgacaggctcttcagacggcagctcgtccaacagaacctcctgcacgggcattccctccgacaccgcatgcaaggacggctcggcaggttcgacagcaccttcaaccgccgccatctcataacgcacgccttctcccggtttgaatacgaaggcggaacggccggcagccaactcttccctcaccgcttctatttttccggcaaactggctcttgagcatattgcaggcaaactggttcttgccgtacaccacccatacgccaccctcctcaccaacggtaaggggcgcaatccattgcgcaaactgcccttgaggcaacatatcgtgaagacggcggaggcacagcggccaaaactctgctaatgtcatggataggctcgaatcggtaaaaatgaaatcgaaaacaaagaaaatataatattttcaaaaagaaaacaaatctgttgaacgcacatcggttcaaaacgcgactgcccgattataccgactcacgaatattttatccacaacccgtgcaaaaatttatccacagaaaggcggcggaaatccgcaggcaatcgggcaatcttcctgcaaagtttctatattgattgacaaaagcggcaaattggagtgtaattcacggtttaattatctacccattctattttaggaaacatcatgaaacgcacttatcaaccttccgttaccaaacgcaaacgcacccacggcttcctggtgcgctccaaaacgcgcggcggccgcgcagtattggccgcacgccgtgccaaaggccgcaaacgcctggcggtataattttggactaccgcttcggaaggcagtaccgcttgttgaaaacggatgatttttcatccgtttttgcattcagaaaccgccgcagccgcgacctgctgcaagtttcgcgctcaaacggcaacgggctgggccatccccgcatcggtctggtggtcggcaaaaaaaccgccaaacgcgccaacgaacgaaattatatgaagcgcgttatccgcgactggtttagattgaacaaaaaccggctgccgccgcaggatttcgtcgtgcgcgtccaccgtaaattcgacagggctaccgcaaaacaggcaagggcggaactggcacaactcatgttcggcaaccccgcaaccggatgcaggaaacaggcatgatcagaacggtactctgcaggcaaggttcagacggcaacgggtttcccatacaaggaacatcccgatgaacttcctattgtccaaactcctgctgggactgatacggttctaccaatattgcatcagcccgctgattccgccgcgctgccgttatacgccgacctgttcgcaatacgcggtcgaagcggtcaaaaaatacggcgcattcaaaggcggccggctcgccatcaagcgcattgcacgctgccaccctttcggcggacacggacacgaccccgttccctgacccgacgcaatattcaaattgcacgctttccttttatttcccatcggtttctatataatgccgtctgaagcttcgggcaggcggcacgaccgccgggtatgaagcccgcccttattccccgtctatcggaacacgcaacctgcggcatttccgaccattcaggaaactcttatggattttaaaagactcacggcgtttttcgccatcgcgctggtgattatgatcggctgggaaaagatgttccccactccgaagcccgtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaaatgccgcagcatgaaaaatgccgtctgaaacctgttcagacggcatttttattgcccaccccctatcggggcggaaatcttcaacccgcatacatcacaaaaatcgtcgggcgttttttcagattgggcatttcttttctttttcgccactgcacgattgtttgactgatgatttcctgtgtcggcaaggtcaaatccgtagccgtgcataaacgcgtttcaggatgcaggttttccaccgcatcggcaagcagcgcatcattgcggtaaggcgtttcaataaaaatctgcgtctcgccgcactggcgcgaacgctgttccaaagcccgaaaagcctgaatccgctcgtttttttcagacggcagatagcctttaaacgcaaaactctgcccgttcgcacccgaagccatcaaagccagcagcaggctggaaggcccgaccagcggacgcacttcaaaaccgtgtttatgcgccaatgccaccaaattcgcacccggatcggccacagccgggcaacccgcctcactgacaatgcccatactgcgcccttcttgcaaaggtttcagcaattccggcaaagtcttcaaatccgtatgttcattcaacgtttgcagattcagctcgcggataggcgtagtcacgcccaaatgtttcaaatgcgcacgcgccgttttttccgcctccacgacaaaatccgtcagcccgacaatcgcctgttgttcatgcggcaacaggcacggcgtgtcaggcgtacccaaaggcgtaggaatcaaatacaaaacaggagacatcattccctcactcatcggttaaaaatgccgtctgagcctttcagacggcataaacgggcagttacagaacctccacgccctcatttttcaagaaatcgaccagacggaaaaccggcaaaccgattaaagcattcggatcggtactctcaatcctttcaatcagcaatgcacccaaatcctcactcttcagcgcacacgaacaataaaccgcatcaggctcgcgctccaaatagcggaggatatgcaactcgtccaactgcctcatcacgaccaccgtcttatcgatatgccgccgcatcctgcccgtaaccgtattcaacagcacgatcgcgctgtaaaactcaatctccctgccgctcaagtgcatcagcatcttttgcgcattggcaaggttcatcggcttgccccactgcctgccgtcgcaccacgccacctggtccgcaccgacaatcaacgcctctgggaaacgcccggtcaacgaccgcgccttaccctcggcaaggcgcaatgccgtctgaggggcggattcccccaacatcggcgtttcgtcaaaatcgggggacgccgcctgaaaggcaatgccgagcctttccatctgttcgcggcggaaaaccgaactcgtacccaaaatcaaaggcagttccaaacccatcccatcctccttaccgttgaaaacacgcccgaaggggcagtaaaatccagccatgcgccgaaacacggatacccgccttcggcgtaccgcaacatttttcttaaaaatattgacgttagaacatctaaattatatcatatcccgtttatgtcagaccctaatttgattgacttggaaatttttgccgccgaagggcagaacctgcaaggcagttttctgctggaagaattggatgaacgcgtcagttcgcacgattatcccgccgacaggcagaccaaaatatcgtttacactgaccggcggtcgcgaccggctgcaacgcctgttcctcgacctgaacgtcaaagccgatatgcccctgatttgccagagatgtatcaaacccatgccgttcatgcttgatgaaagcagccgtatcgtcctgttttccaacgaagagtccttggacgaatccatgcttgccgacgaagaactcgaaggcatactgattgaaaaagaactcgacgtgcgcacattggtagaagaccaaatcctgatgtccctgcccttttcgccgcgacacgaagactgcggcgacaatgggacactggaagaagtcaatcgggacaaacccaacccctttgctgttttggcaggtttgaaaagcaattgattaggacacagtttatttatctaggagcttgaaatggccgttcaacaaaacaaaaaatccccttccaaacgcggtatgcaccgttcgcacgacgcgctgaccgcgcctgcactgtctgtcgacagcacaaccggcgaagtacaccgcccgcaccacatctcccccaacggtatgtaccgcggccgcaaagtggtcaaagccaaaggcgaataatccctattcgactgactgaaaaagccagaacattgccatgcaattactggctttttttgcattggacgcaccatccgtccaaactttcgccatacgtcaacacacaggggcaaagcgttccgtataataccccgtgaaaatattccaaaagccccaaccaccaaggaaattccgatgaaacagaaaatctggtacacctacgatgacatccaccgcgtcatcaaagcattggcagaaaaaatccggaacgccgacatcaaatacgatgccatgattgccatcggcggcggcggctttattccggcacgtatgctgcgctgttttctggaaattccgatttatgccgtaaccaccgcctattacgacagcgacaacgaaggacaggttaccgaagaagtcaaaaaagtccaatggctcgaccccgttcccgaagccctgcggggcaaaaacgtactcgtcgtcgatgaagtggacgacagccgcgtaaccatggagttctgcctgaaagaactgctcaaggaagacttcggtacgatcggagtcgccgtactgcacgaaaaaatcaaagccaaagcaggcaaaatccccgaaggcattccctatttcagcggcatcaccgtagaagactggtggatcaactatccgtgggacgcactcgacatcgacgaacacaaccgccttgccgaggccggccgaggctgaccctttcagacggcatattttccgaaccgatgccgtctgaagcccgcacgacccctgccgcagaccgaaaacctaccggagaaaccctatgattacattggccgtagatgccatgggcggcgaccaaggacttgccgttaccgtacccggcgcaaccgcattcctccaagcacaccccgatgtccgcctgattatgaccggcgacgaaacgcaactgcgccaagccctgaccgcggcaggcgcaccgatggaacgcatcgacatctgccataccacccaagtcgtcggcatggacgaagccccgcaatccgccctgaaaaacaaaaaagactcctccatgcgcgtcgccatcaaccaggttaaagaaggcaaagcccaagccgccgtatccgcaggcaacacgggtgcgctcatggcaaccgcacgtttcgtcctcaaaaccattcccggcatcgaacgccccgccatcgccaaattccttccttccgacaccgaccacgttacccttgcactcgaccttggcgcgaacgtcgactgcacgtccgaacagctcgcccaatttgccgttatcggcagcgaactcgtccacgcactccatcctcaaaaaggacagccgcgcgtcgggctggtcaacgtcggcacggaagacatcaaaggtacggacaccgtcaaacaaacctacaaactgctgcaaaacagcaaactcaactttatcggcaacatcgaaagcaacggcatcctctacggcgaagcagatgtcgtcgtcgccgacggctttgtcggcaacgtcatgctcaaaaccatcgaaggcgcggtcaaattcatgagcggagccatccgccgcgaattccaaagcaacctgttcaacaaacttgccgccgttgccgccctacccgccctcaaagggctgaaaaacaaactcgacccgcgcaaattcaacggggccatcctgctcgggctgcgcggcatcgtgattaaaagccacggcggcacagacgaaaccggtttccgctatgccctcgaagaagcctaccacgaagccaagtccgccggcctttccaaaatcgaacagggcgtagccgaacaactcgccgcactcgaaactgccaaagccgtccaaaacgaaaatgtcggcggtctgtaacacacacgatgccgtctgaacgcccccgcccctttcagacggcatccgcccgcaccaaacctgcgggcgcggacggcgatgcgcctgtccggcacttcccaaatatcgccttgtaaaataaggagtatttgaaaaatgaagacattagaaaaacggatgaaagctctagacaaacggattatgaagttcggaaaatcccttgaaggcaggcttgatgcccgtctgattgaatccgcattggattatattcattattcggaacgttttttggcttttgaaatcctgtgtacttatatcgaagatttcgatgtccggctgacggaacaagaatcccgggaaatttcttttatcaacaaggaatttgagatagaaagcacgtccgattaaccaataaagccaatgggttgataaacatgaaaacatcgacggtcgtttttggcggattttttatggcagacaacggagagcgaatccaaatccccgttttggaaaatcctgacattagggaaatcaatcactttttttccgtatcaaattttgagaaaaaaaccggcgtccttgttttcagaatcatccccgagccggaatttggcaataccgaattaactgtctattttaaaaaaggatattatagtggattaacaaaaaccagtacggcgttgcctcgccttgccgtactggtttttgttaatccactatatcagacgaaaacaaacacccgcgccaatagcctgacggcaacccggcaatcaaaatgccgtctgaagcagcttgggctttcagacggcatttccttcgcttaaaacagcgtatcggcaaccccgccctgcctgtccacggcaatctgcatctgaaaaccatctgtatcccaaaccacacccccatccctgtttccatcatgtgcaccctgtccgtattgggcaatcatctgtttttcgcttacaatagccgaatctgaaccaactctctaaaaaggccgttcccatgcagtatgcaaaaatttccggcacaggcagctatcttcccgccaaccgcgtcagcaatgacgaccttgcccaaaaggtagatacctctgacgagtggattaccgcgcgcacgggcatcaaattccgccatattgcagccgaaaacgaaaaaaccagcgatcttgccgccgaagcggcgcaccgcgcgctggatgcagccggattagacagcggcgaaatcgatttgattatcgtggcaacggcaacgccggatatgcagtttccgtctactgcgaccatcgtgcaacaaaaattgggcatcaccaacggctgccccgcgtttgacgtacaggcggtgtgcgccggctttatgtacgcgctgaccacggcaaacgcctacattaaaagcggtatggcgaaaaacgcgctggtcatcggcgcggaaaccttcagccgcattgtagactggaacgaccgcacaacctgcgtattgttcggcgacggcgcgggcgcggtggttttaagcgcgtcggacacgccgggcatcatccacagcaaactcaaggccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgctcaaatcgactggattgttccccatcaggcaaaccgccgcattatcgaatcgaccgcgaaacatttaggtttgagtatggacaaagtcgtcctgaccgtccaagaccacggcaacacatccgccgcatcgattccgctggctttggatacgggcatccgcagcggacaaatcaaacgcggtcaaaacctgctgctcgaaggcatcggcggcggtttcgcgtggggcgcggtgctgttgcaatattgaacccgatgccgtctgaaacaggctttcagacggcatttcccatatcatgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctgattatccaaccaaacaaaggaatactatgtcttttgccttcttttttcccggacaaggttcccaaagcctcggtatgatgaacggctttgccgaacacgccatcgtcaaaaacacctttgccgaagcctccgccatattggggcaggacttgtgggcgatgataaacggcagcgatgccgaaatcatcggtcaaaccgtcaacacccagcccattatgctcgccgccggcgttgccgtttaccgcgcctatttagaagcgggcggcaaaacgcctgccgccgttgccggacacagcctcggcgaatacaccgcactcgttgccgccggcgcattgaattttgccgacgcggtcaaactcgtgcgcctgcgcgccgaactgatgcagtccgccgtaccgcaaggcgtgggcgcaatggcggcgattctcggcttggaagatgagcaggttaaagccatttgtgccgaagccgcccaaagcgaagtggtcgaagccgtcaacttcaactcacccggacaaatcgtgattgcaggcaacgccgccgccgtcggacgcgccatggctgccgccaaagaagccggtgccaaacgcgccctgccgctgcccgtgtccgtaccttcccattgcagcctgatgaaacccgccgccgacaaacttgccgaagccctgaaaaccgttgaaatcaagcagccgcaaatccgcgttatccacaacgccgacgttgccgcctacgatgatgccgacaaaatcaaagacgcgctcgtccgccagctttacagccccgtacgctggacggaaaccgtcaacgccctcgtttcagacggcattgccgaatccgccgaatgcggcccgggcaaagtgttggcgggcttggcaaaacgcatcaacaaagccgccgcgtgcagcgcactgaccgatgccggacaggttgccgcctttatcgaagcgcactgacttcgttctgcaaaaagcagcctgccctcttcaggctgcttttcatgtccgaacgacggcagccccatatttacgctataatccatcccgaccaaaccaccgacagcggctgccgttgcagttcccgccctaccgatatgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctaccttgccgccttcatcgcccccctgattaaccacggcttttccgcacctgccgcgccgcccgagctgtctgccgccgccggcatcatttccaccctgcaaaactggcgcgaacagtttacctatatggtttgggggacggaaaacaaaatctggaccgtcccgctcttcctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgatcgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggtgtatgtgcatttctcgacaccccgcccgaacaggacaagggcacgctcgcaccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaacctgctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgttcgccctccaaaccgccaacctgcaaagcctgattgacagctccccgctcggactgcaccagcccatcggatcgaacggcagcaacttatccggcggacagcggcaacgcgtcgccattgcccgcgccattttgaaagacgcgccgatattattattggacgaagccaccagcgcattagacaacgaatccgaacgcctcgtccaacaggcgctcgaacgcctgatggaaaaccgcaccggcatcatcgtcgcccaccgcctgaccaccatcgaaggggccgaccgcatcatcgtgatggacgacggcaaaatcatcgaacaaggcacacacgaacaactgatgtcccaaaacggttactacacgatgttacgcaatatctcaaacaaagatgccgccgtccggacggcataaacaaaatgccgtccgaaatggtacaatcgccccgaccctttcagacggcatcatatccgccgacccatccgattatcttcaatcactgtaaaacccattatgacccaagacaaaatcctcatccttgacttcggttcgcaagttacccagctcatcgcccgccgcgtgcgcgaagcccacgtttactgcgagctgcattctttcgatatgcctttggacgaaatcaaagccttcaaccccaaaggcatcatcctctccggcggccccaattccgtttacgaatccgactatcaagccgataccggtatttttgatttgggcattccggttttgggcatctgttacggcatgcagtttatggcgcaccacttgggcggcgaagtgcagcccggcaaccagcgcgaattcggttatgcgcaagttaaaaccatagacagcgagctgacacgcggcattcaagatggtgagccaaacacactcgacgtatggatgagccacggcgacaaagtgtccaaactgcccgacggtttcgccgtcatcggcaacaccccgtcctgcccgattgccatgatggaaaacgccgaaaaacaattctacggcatccagttccaccccgaagttacccacaccaaacaaggccgcgccctgttgaaccgctttgtcttggatatttgcggcgcacaaccgggctggacgatgccgaactacatcgaagaagccgttgccaaaatccgcgaacaggtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaagcaaaatggtgatggatatgttcgcccgcaacttgggtgtgaaagtgatacacgtcgatgccgaagggcagtttatggcgaaactcgccggcgtaaccgaccccgagaaaaaacgcaaaatcatcggtgcggaatttatcgaagtatttgatgccgaagaaaaaaaacttaccaacgccaaatggttggcacaaggcacgatttaccctgacgtaatcgaatccgcaggtgcaaaaaccaaaaaagcccacgccatcaaatcgcaccacaacgtcggcggcctgcctgaaaacatgaagctcaaattgcttgagcctttgcgcgatttgttcaaagacgaagtacgcgaattgggtgtggctttgggcctgccgcgcgaaatggtgtaccgtcatccgttcccgggtccgggtttgggcgtgcgtattttgggcgaagtgaaaaaagaatatgccgacctgcttcgtcaggcagacgatattttcattcaagaattgcgcaatactaccgatgaaaacggtacatcttggtacgacctgaccagccaggcattcgccgtgttcctgcccgtcaaatctgtcggcgtaatgggcgacggccgcacatacgattacgtcattgccttgcgtgccgtgattaccagcgactttatgaccgcgcattgggcggaactgccgtattccttgttgggcaaagtgtccaaccgcatcatcaacgaagtcaaaggcatcaaccgcgtggtttatgatgtgagcggcaaaccgcctgccaccatcgagtgggaataaacagcaaacatggctgccccgtccggcgcagtccttcgattatcggaaaaaaggaaaaaatatgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaacagacaactttttcaaccatgccgtctgaagccctttcagacggcatttgcattctcaggcaaaatgaacacacaccacaccccgccctgcccatgcggctcaggcacaagctgagacctttgcaaaattcctttccctcccgacagccgaaaccccaacacaggttttcagctgttttcagctgttttcgccccaaataccgcctaattctacccaaatacccccttaatcctccccggacacctgataatcaggcatccgggtcaccttttaggcggcagcgggcgcacttagcctgttggcggctttcaaaaggttcaaacacatcgccttcagatggctttgcgcactcactttaatcagtccgaaataggctgcccgggcgtagcggaatttatggtgcagcgtaccgaagctctgttcgaccacatatagtggattaacaaaaaccagtacggcgttgcctcgccttagctcaaagagaacgattctctaaggtgctgaagcaccgagtgaatcggttccgtactatttgtactgtcttcggcttcgtcgccttgtcctgatttttgttaatccactatacatcatcgctactaccgttccggcgcaacaggcattcctcgatgccgccgaactgatgcaatggagtatagaaaccgaagggctgggcttgaacgtcatctcgcacaagatactcggcaaagaccacgcccaagtcgaatttgaagcctacttccgagacggacaacaccgatccgcgcatcacgaactgtccggcttcgtcaacatcggcggacaatggtattttatcgatcccaccgttccgcatcctgcgatgaaacaaccctgcatttgcggatcaggcaaaaaattcaaagcctgctgcggcaaatatctgaaacctgtcgcataaaaatgccgtctgaacgttcagacggcattttcaacgtgcaaaaaaaaccattcataccaagggtaagtatgaatggtcaatacattgcgggaaaacgtcttacttgctgcactgccgaaaagggagaaacggcagcggtaatcagcggaaaggattgtacccgaattaatattaagaaacgttaatcgcgaaaatatattaacaaacctgttgaaacctattggttttcccgtatccacccgacccagcgttcaaacagcttcggttcgagcgcggcaacgaccgagcgtttgaacacgtgttcaccactccaaaacccgtcgccttccaaagtcgtcagcctgccgcccgcctcctcgaaaatcaacgcgccggcggcataatcccacagcttctgcccgccgtgaacataaacatcataacgcccgcacgccagataacaccaatccaacgtactgctgcccatactccgtatcgttccaaaaggcgcgagcgtactcatacggctggaaagtttgcccgaacgcagatatttgatttccacgcccgcaatcgcctcattgagttttttatccacgaggcgcaggggcagacgcgtcccgtttaaaaacgccccctgcccgcgttcggcataaaaacattcgccgctgactgggttgtagattacgcccaactcggcgcgcccgttgcggacaaacgccaccgataccgcaaaatgcggcagcccgttgacaaaattgttcgtcccgtctatcggatcgacaatccacagccccttttcccccgaatattgttcccacaaagccgactgttcctgccgcgacatttcctcacccaacatcggactgtcgattaaaagcggcaacgcggcggcaaaagccgtctgcgcggcaatgtccgcctcgctcaacatcgaaccgtcttccttgcggtgagacggcgtattcaaaaaacgcggcataatttcggtttgcgcgatatggcgcacgactttctgcaaacggtgtaacacttcctactgtcctcatattttgaacttgcggcgcgcgaacgtataatgtccgcttccatcacgccgctgcgacggattataaccgtccgaaccgccaaaaactatgccccgattccacctgcccgaaaacctttccgtcggacaaaccgtcgccctgcccgacaacatcgtccgccacctcaacgtcctgcgcgtccgccccaacgaaaacatcaccctcttcgacggcaaaggcaaggcacacgccgcacggctgaccgttttggaaaaacgccgcgccgaagccgaaatcctgcacgaagacacaaccgacaacgagtccccgctcaacatcacactgatacaatccatctcctccggcgatcgcatggatttcaccctgcaaaaaagcgtcgaactcggcgtaaccgccatacagcccgtcatcagcgaacgctgcatcgtccgcctcgatggggaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaagcaccaagctgattatgagcatcaaccgcgcccgcaaactcggcgacatacgccaaccgtccggcgcaatcgtctttatggtcgggcccgaaggcggctggacagaacaggaagaacaacaggcatttgaagctggctttcaggcggttacactcggcaaacggattttacgcacagaaaccgccccactcgccgccctcgccgccatgcagacgctttggggcgatttcgcataaacagaaatgccgtctgaaacccgttcagacggcattttgcagccgattaagatagtaggttcaaataagatttcccgtgtcgtcattcccgcgaaagcgggaatctagaaacgaaaaactacagagatttatccgaaacaacaaccctctccgccgtcattcccgcaaaagcgggaatctagaaacgaaaaactacagggatttatccgaaacaacaaaccctctccgccgtcattcccgcgcaggcgggaatctagaaacgaaaaactacagggatttatccgaaacaacaaaccctctccgccgtcattcccgcgcaggcgggaatctagaaatttaacgttgcggtgatttatcggaaatgactgaaactcaacggactggattcccgcctgcgcgggaatgacgagattttaggtttctgtttttggttttctgttctcgcgggaataacggaattttaagttttaggaatttgtcggaaaaacagaaatccccccgccgtcattcccgcaaaagcgggaatctagaaacgaaaaactacagggatttatccgaaacaacaaaccctctccgccgtcattcccgcgaaagcgggaatctagaaatttaacgttgcggtgatttatcggaaatgactgaaactcaacggactggattcccgcctgcgcgggaatgacgaattttaggtttctgtttttggttttctgttctcgcgggaataacggaattttaagttttaggaatttatcggaaaaacagaaatccccccgccgtcattcccgcgaaagcgggaatctagaaatttaacgttgcggtgatttatcggaaatgactgaaactcaacggactggattcccgcctgcgcgggaatgacgaattttaggttgctgttttttggttttctgtttttgcgggaatgacgaattttaggtttctgtttttggttttctgttctcgcgggaataacggaattttaagttttaggaatttgtcggaaaaacagaaatccccccaccgtcattcccgcaaaagcgggaatctagaaatttaacgttgcggtgatttatcggaaatgactgaaactcaacggactggattcccgcctgcgcgggaatgacgaagtggaagttacccgaaacttaaaacaagcgaaaccgaacggactagattcccgcctgcgcgggaatgacagtgtatccatttctaattttaatccgctatattttacacaaactatttgaacgatatgacccgcctgccgtaagctttctcaagctccgcctgcctttgacgctccattcttttcttcttttccctaccgaatttacccaaagcacgcttcaagtcaaacatcaccttcaacgaacggcggtgtcttctttcttgttccctatctttttccaaatcgctacccaacatactgtttttactgaggaacttggcataatgcaattcttgggtacataaggcgggattaacctgataaacaggcatcccctccttatcaaagaaataagtaaacatcatccaatctaccgctttaatccactctgccggcaaaacggcaaacctttccaagaaaaaccgcatcgcctcacgcgaaatgatatagccagccgtcccccaatgttcgctctccagcaaaggaaatgaccgattctcataattcaggactttatccggtctgacaataactttcgcaaacatcgtttccaaacgaacgataaaggcagaatccttatcaaaacgctcttccaaccaagtatcttcggcaaggaacttttctgcgtctttgccaagcaggacatcatcctcaaatacggcaacatagggcagaccttcatccaatgcctgtttccacaatacggcgtggctcataaagcaggctttttccacttcgctcaacaggtgctgttttgccaatcccggcaccaattccgccatcatccgattcagttcttcagacggcatcagtgcgtcgaaaaactgaaacgggatgccgcgcacgccgaaggttgcggcaatgtgcgccctgcgttctgcggcggaagctaagctgataacatggttttgcataatttatcctgttttttgtctgttggataaagcggcgtttttcaacggtttttcagcaatcggcgcaaaatgccgaagtattgcctcaaggtaaacagccgccgcatcctgccgtctgctgcaaatacgatgtccatctctcctccttttattggaaaggcacaatgaactgttcgcgcctttgccggcgtttttccctttccctgctgattttggtcaaggcgcggatcaggcggtgtttgaatgtgttggcgggggaatcgcgcctttgctgtttgcggttcaggaggcggtcgtgttcgatcaggctgcccaatgcgctgttttggtcgtgaaacttggcataatgcagctcttgggcgcacaaggcgggattgagctggcaaaccggcattccttccctgtcgaaaaaatcgctgaacatcatcagatcgacggggtgcagcccttcgggcggcagggcggcaaacctgtccaggaaaaaccgcatcgcttttcgggaaatgatatagcccgccgtcccccagtgttcgctttccaacagcggaaaggcgcgcccgcagtaatccgccacgccggagggcgaggtcaggacgtgcataaacatcgtttccaagcggacgataaaggcggtatccgggtcaaagcgttcttgcagccaagcgtcttcggcaaggaatttttccgcaccttcgccgagtaaaacgtcgtcctcaaatacggtgatatacggcagaccttcgtccaatgcctgcttccacaatacggcgtggctcataaagcaggctttttccactccgctcaaataggggtgcgccgacaagccggggacgagttccgccattgcctgttccagcctttcagacggcatcagtgcgtcgaaaaactgaaacgggatgccgtgcctgccgaaggtatcggcaatgtgcgccctgcgttctgcggcggaagctaagctgataacgtggttttgcataatttatcctgttttttgtctgttggataaagcggcgtttttcaacggtttttcagcaatcggtgcaaaatgccgaagtattgcctcaaggtaaacagccgccgcatcctgccgtctgccgcaaaatccagccacgcgccggcgggcagcgtgtccgtccgtttgaagcattggtacaaaaaccggcgggcgcgttcaaaatcttcttccggcaaatgtttctccagcaattcatacgctactgcttttatttggcggtattcaaggctgtcgaaccgggttttaaaacccatagactgcaaaaaatcgtttctggcggttttttggatgccttgcgcgatttcgtgttggcggatgctgtatttggatgaaacctgattggcgtgaaggcggtatttgaccaaggcttcgggataataagccagcctgcccaatttgctgacatcgtaccaaaattggtaatcttccgcccaatcccgctcggtgttgtaacgcaaaccgccgtcaatgacgctgcgcctcataatcatcgtgttgttgtgtatggggttgccgaaagggaaaaagtcggcaatgtcttcgtgtcgggtcggttttttccaaattttgccgtgttcgtggtgccgcgccagccggttgccgtccttttcttccgacaaaacttccagccacgcacccatcgcgatgatgctgcggtctttttccatctcacccacgattttctcaatccagtcgggggcggcaatatcgtctgcatcggtgcgcgcaatatattccccccccccccccgactttgccaattcatccagcccgatgtttaaagagggaatcagaccggaattgcgcggctgcgcgaggatgcggatgcggccgtcctgttcttggaaacgctgggcaatggcaagcgtaccgtccgtcgagccgtcatcgacaatcaaaatatccaagttgcgccaagtttgattcacgacggcggctaatgattgggcgaaatatttttctacgttgtaggcgcaaatcaatacgctgactaaaggctgcaatttattctcccgataggcacgatgccgtctgaaggcttcagacggcatttggactgtacaacggttactcgcccaaaagcgcgatatccgctaccgcgttcatttgttctgccaagcggttcagcaggttcaggcggttttgtttcacggcggcatcttccgccatcaccatcacgccgtcgaagaaggcatcgacttgcggtttgacggaagccagttcggacaaggcggtctggaaattgccttcggcaacggcggcggcaattttcggctgcaagccttgtgcggcggcaaagagggctttttcttcgtcctgttgcagcaagctttcgttaaccgcgcccaactcggcatcggcttttttcagcaggttttgcacgcgtttgttggcagcggcgagcgcggcggcttcgggcagttgtttgaacgcggcgacagcctgcagtttggcggtcaaatcgtccaaacggcgcggctgcttggcaagtacggcggcaacgatgtcttgcggataatcgttttgcagcaatacggcaaggcgcgcctgcatgaagtcggcggtttcagacggcgttttttcgttgagcaaaccttgcgggaagctgttgaaggccgtctgaatcagttcgtttacgtccaaaccgtactgcatcagcatacgcaaaatacccaatgcggcgcggcgcagggcgtatgggtctttgtcgccggtcggaatcaggccgataccccaaatgccgaccaaggtttccagtttgtcggcaagcgcaacggcggcggcaattttgccctcaggcaggttgtcgccggcaaaacgcggttggtagtgttgctcgacggcttcggtaatttcttcggtttcgccgtccaagcgggcgtagtatttgcccatcgtgccttgcagttcggggaactcgccgaccatttcggttactaagtcggcttttgccaaacgcgcggcgcgttcggctgcggcggcatccgcgcccaaagccttggcgatatgggcggcgatgctttgcaggcgttcgatgcgttcggcttgcgaaccgattttgttgtgataaaccacgttcgtcagtttgggcaggcggctttccaaagtcgctttttggtcttgtttgtagaagaactcggcatcagacaggcgcgcgcgcaagacacgttcattgccttggatgatgtgtgacggatcttcggtttgcagattggacaccagcaggaagcggttcatcagcttgccgttttggtcgagcagcgggaagtatttttggttttgctgcatcgtcagaatcaggcattcttgcggtacggcgaggaagtgttcttcaaaaccggcttccaataccacaggccattcgaccagcgcggttacttcgtccaacaaggcttcatcggcggcggcggtcgcgttcagacggcgtgcctgcccttccaataccgtctgaatcgcggctttgcgctcggcaaacgaagcgacgactttgccttgctcgcgcatttgtgcggcgtagctgtcggcgttttcaatggtaatttcgccgtcggagaggaagcggtgtcccaaggttttgttgccgctttgcagacccaaaacgctgacgttcacaatgtcgccgccgtgcagtacaactagcccgtgaacggggcgcacaaaggtaaacgtgctgctgccccaacgcattactttgggaatcggcagcttcttaaccgcttgattgataatgtcttccaaaagtccgcccaacggtttgccgatttggacgtattcgtaggcgtacacgtcctgcttgccgtcgtggacgatggtcaagtcttcgattttcgcgcccgcaccgcgtgcgaaaccttccaaagccttggttggcgcaccgtctttcatggcattcgctacggcagggccttttttcacaattttttgatcagcctgaacggctttgacgtttttgacttgaaccgccaaacggcgcggcgaggcataagccgtaaattcggctgcgccgtcaaccagttgcgctttttccaagccttcggcaacggaagcggcgaaatggttgcccagattattcagggctttgggcgggagttcttcggtaaggagttcgattaaaagggtttgggtcatcattcggctttctttgaatttggttaatctgcctgtttataggtttcgctgtaattttcccagccgtcatccccataaaaaccgtcaaccagcggggtggcgtacaaagtggcaacatcttcgcggtctgccagccaagagataatggcttttttctcggtttctcccaagcttcgggcaccggatttttgaaacaggcacgaaaaatcgccgcaatcgcccccccgccatttcaaagccgtttgccgcaagatacgcaatcagctcgtccataaagcggtcgaacgcttcggcatcgtcctcagcttggtgcaaactgccttgaacgccgaaaatcaatgtttgaaactcgcccaaatgcagctttttatgctggcggcggttcattttgtgcaggcgtttcctgcttggggtgcggaaatagacaggcatgattttcctaaaaaatataatggcttccggacggctgccttatcgtgccgcccgaacgtaaaaaatcgtcgcccccttaggcggcgtttgccttcattaaagggaagcccagtttttcgcggctttcaacatatttttgcgccacggcgcggctcaatgcacgaatacgtccaatataagttgcccgctcagttacggaaatcgcgccgcgtgcgtctaaaaggttgaacgtatgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatgattcgataaaataaagggtttattttactgtttccattgctgtttggataggtttatctcaaagacagactgatttgaaaacacggcatacatgatatagtggattaaatttaaaccagtacagcgttgcctcgccttagctcaaagagaacgattctctaaggtgctcaagcaccaagtgaatcggttccgtactatttgtactgtctgcggcttcgtcgccttgtcctgatttttgttaatccgctatatgtttcggttaggcggcaggctgccctattgaataccttaaagcaggctatgcctgccaacgccatatccaaacacagtctttaatttaaatccggaaaataaaaagcacgaccaaacggtcgtgcttttccaaaccaaacaagtttatttcttgtgcgaacggatatagtccaaagttttgagctgtgcaatcgcagcagccaatactttatgcgcttccgccaaagccttatcgtctttagcttgggaaatgcccgcttctgcggcttttttcgcctcttccgcacgtgcccgatccatctccgcactgcggacggcaacatccgccaagacagttactttatcaggctgtacttccaaaacaccgccggaaacagcaaccaaaacctctttatcctcgcccggaacggtcaaacgcaaagcccccggccgcaccaaactcataatcggctcgtgtcgcggataaataccgagttcgccctgtacagtcggaacaacgataaatgttgcctcgcctgaatagattttctgctcgctacttaccacctcaacttgcatgatgctcatgccgacctccttagtttaaggttttcgctttctctactgcttcttcaatgctgccgaccatatagaatgcctgctcgggcagatgatcgtattcgccgttcaagatggctttgaagccggcaatggtatcgcgcagggcgacatatttacccggagaacctgtaaacacttcggcaacgtggaacggttgggacaggaagcgttggattttacgcgcacgcattacggtcagtttgtcttcatcagacaattcgtccatacccaagatggcgatgatgtcgcgcaattctttgtatttttgcagggtggactgcacaccgcgcgccacgtcgtagtgctcttgacccaataccatcggatccagttggcgcgaagtagaatcaagcggatcgactgccgggtaaatacccaaagaggcaatatcgcggctcaatacgacggttgcgtccaagtgggcgaacgttgttgccggagacgggtcggtcaagtcgtccgcaggtacatatacggcttggatggaagtaatagaaccggtttgggtagaggtaatacgctcctgcaaacgacccatttcttctgccaatgtcggttggtagcccactgcagacggcatacgacccaacaatgcggatacttcggtaccagccagggtgtaacggtagatgttgtccacgaagaacaatacgtcgcggcctttgccgttttcgtctttttcgtcacggaagtattccgccatggtcaaaccggtcaatgcgacgcgcaaacggttgcccggaggttcgttcatctgaccgtaaaccattgccactttatccaatacgttggaatctttcatctcgtggtagaagtcgttaccttcgcgggtacgctcacccacgcctgcgaacacggacaagccgctgtgcgctttggcgatgttgttgatcaattccatcatgttcacggttttacccacaccggcaccgccgaacagacctactttaccgcctttggcaaacggacacagcaagtcaatcactttaatgcccgtttcgagcaattcggttgtggaagacagttcgtcaaacttaggggcagcttggtggatggcacggctcttgtcggtatcgatcggacctgcttcgtcaacaggcgttcccaatacatcgacaatgcgtcccaacgtacctttacctaccggcacagtaatgggcgcaccggtattgctcacagtcatgccgcgtttcaaaccgtccgagctgcccatcgcaatggcacggactacgccgtcgcccaaaagctgttggacttccaaagtcagaccgttttcgtctaatttcaaagcgtcgtaaacgcgcggaatcatgtcgcgtggaaattccacgtcaacaaccgcaccgataatttgtacgattttgccttggctcattatcgtatcctaatttccgtacaggattcagacggcatcagacagccgccgcacctgctacaatttctgacaattccgtggtaatcgcagcttgacgcgatttgttatataccaaacgcaactctttgatggcattgcctgcattgtctgttgcagctttcatggcaaccatgcgggctgcctgttcggatgccatattgtcgctcaacgcctgataaaccacagactctaaatagcggcgaaccagatattccaacactgcaagtgcagtcggttcgtagcggtattcccagctgaacggtgatttgggagctgaatcgccaatcacgttctcaccgataggcagcaatacttccattctcggttcttgacgcatggtattgacaaaacccgaatacaccagatggattctgtcaatttcatgtttctcataccgttggaagagttctgtcaaaggtccgagcagcatttccatttttggggtatcgcccaaatttacggcactggcaaccacattcagaccaatgctctgacacgccatcagacctttactgccaaagcatacgatttcctcttcaataccttgattccgatactcttgaacttgtgccaaaaactttttcagcacgttggcgttcaaaccgccacacaaacccttatcagacgtaatcaaaataaaaccgacacgtctgatttcccgatgagattccagtaacggaataccatgatcggtattggtttgcgcaagatggctcatcaccatacgcactttttcggcatacggacgcgccaaacgcatccgttcctgagtcttccgcattttagaggttgacaccatctgcatcgctttagtgatcttttgggtattctgaacactgcggattttggtgagaatctcttttcctactgccatttcagactcctttcacttcaagccttatgcctgataggcgtaagaagatttgaaggatttcatggctgcttcaagcgttttctcgctctcgtcggacattgcacctgaagcattgacggcttccaaaacttccggatgttgggtacggacaaagctcaaaaattcagattcaaaagccagagctttggcaaccggaacatcagaatacgaaccgttgttgattgcccaaagggtcaaagccatttcagccgtattcaacgtactgaactgtttctgtttcatcagttcggttacgacttcgccatgctccaattgtttgcgcgtagcttcatccaaatcggatgcaaattgcgagaacgccgccaattcacgatattgtgccaacgccaaacggataccgccacccagctttttaatcactttggtttgtgcagcaccgcctacgcgggatacggaaataccggcattgattgcaggacggataccggcgttgaagaggtcggtttccaagaaaatctgaccgtcggtaatcgaaatgacgttagtcggaacgaaagcagatacgtcgcccgcttgggtttcgataatcggcaacgcggtcagagaaccggttttgccttttacttcgccgttggtcaatttctccacttcgtgttcattgacacgtgccgcacgttccaacagacgggagtgcaggtagaacacatcgccgggataggcttcgcggccgggcggacggcgcaaaagcagggaaatttgacggtaagccacagcctgtttggacaaatcgtcataaacaatcaaggcatcttcgccacgatcgcggaagaattcacccatcgtacaaccggagtaaggtgcgatatattgcaatgccgccgcttcagatgcagttgcagcaaccacgatggtatgctccatcgcgccatgctcttccaatttgcggaccacgttggcaatagaagatgctttttgaccgatagcgacatagatacagataacacccgtacctttttggttgacgatggcatccaatgctacggccgttttacctgtctgacggtcgccaataatcaactcacgctgaccgcgaccgacaggaaccatagagtcaatcgccttcagaccggtttgcatcggctggtcaaccgatttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatgataaggtcaagtcttgatattgagcatatacttccggcaatatcgacaaacgtttctgcccggccaagacgataacaaagtttttcaactccttgtctttcaaaccgaccaaatcgatgaggatatctgctttttctgaagcattcgtttcaggacggtcaatcaatgaagccaccttcccttcctgaacaaccgccgcaagtttttccagtccgcccaaccaagactcaatttggtttttttcctgagccagaccgaacaatgcctttgcataaggtctggcaatcgttgcgaactctgccataagattacagctcctgtttcagggtatcgagcagttttgcgtgtttggaagcatcgacttcgctgcgcaaaatagattcggcacctttgacagccaacacggcaacctgctcgcgcagggattcgcgtgcgcggaacaattcctgctccacatcggcctttgcctgagctgcaatgcgcgccgcctcggaagaagcctgttctttggcttcttcgacaattttggcggcacgtttttcggcgttggcaaccatttcggaaacctgattacgcccttctgccaagagttctgcaacctttttttcagcctgctcaaaatcgcttttaccacgctcggcggcagccaagccttcggcgacttttgcggcacgctcatccaaagcttttgcaatcggcggccacacgaatttcatggtaaaccataccaaaccgaaaaagacgatgatttgagcgaataatgttgcattgatattcacgttacttaaccttcgtactggggttaatcaaacaggctgcgcctgtacggaacggacgaatccgtcctgattatgcacctgcaaacgggttaacgaaggcgaacagcagtgcaatggcgacaccaatcaagaatgcggcatcaatcaaaccggcaatcaggaacagtttggtttgcagcggaccgatcagttcgggctgacgggcagaagactccaaatatttagaaccgaccattgcgataccgatagaggcacccaatgcacccaatgcaacgatcaaaccacatgcgatagcaatcaaacccattttaaactccttaaagaaacaaaggttaaactacaaaaacaaactacttaggaaaatcagtgcgcatcatgtgcctgtccgatatagacgaacgccaacgccatgaaaataaacgcctgcagggtaatcaccaaaatatggaaaatcgcccatgccaaaccggcaataatgtggaatacaaacagaatcggatccatgacttcgacgctgccggaagccgcccaagcaccgccaagcaaggctatcaacaagaataccaattcgcccgcatacatattgccgaacaaccgcataccgtgggatacggttttagaaagaaactcgaccaaattcaacagaaagttcgcaggtgcgagttttgcaccgaacggcgcgctgaacaactcgtgaaaccagccacccaatcctttgattttgatgttgtaatagatacaaatcagcaacacgccgacagcgagtgccaaagtggtgttcaaatcggcagtcggtacgacgcgcagcagggcgtgatggttgccggtaatgccctgccataccatcggcagcaaatcgaccggcagcatatccatcgcgttcatcagaaaaatccagacaaacagcgtcagacccaacggcgcgacggcttttctagacttttcgttgtgaatgatgctcttacacatatcgtccacaaactcaaacaagatttccactgcggcctggaaacgtccgggaacgcctgccgtcgctttttttgcaccgcgccacaacagaaagctgccgattacgcccaacaggacggcaaaaaagacggcatcaaggttaataaacgaaaaatcagcaatgtttttcagtccctgaccctgagtaacatccgacaaactggtcaagctctgcaagtggtgcttgatgtagtcggcagcggtaatggtttcacctgccataatctttcactctcaacaatactaaaaaaaccaaatggctgacaccgagcagccccatcagaaacggggcgaacaccagcgattgatgccatattgcaaatacggcaagcatggacaacagcgacagcactacttttaaaatctctccgaagacgaacatcctgctttgcaggaaggggtttcccctgaaaagttttaaaagtaaaactgcaacaaacgtgggaagcaggtaggacaaaccgccaccgaccgccgaaaggaatccggcaaaaccccatacagcaaaggcaactgcggcgcatatggacaatacggcggattgtaggatgataatctgcttcataaagggaatgtttccgcctcggatttggggcgcggctaatataatttagaagccttattacgtcaagcgacagttaatctttgtgaaacaacgtatcccaatccgccgcgctcgccgcctgaataacggcgacaggtgtcattctaacacacattacatataattacaggatattaaggagtttgtccgcaatttctttacatttttaatgttcttacgtgatttgtttgctttacgtggaaataataaaaaatcaacgcgaaattgtagcagtttatcggtcggattgtcggcagtttggggaatttgctcaataaataaaaggtcgtctgaaaatattttcagacgaccttttccgaataaaggattagcaactgcctgccgctttaagcaaagcattgcattgacttttgcctttgtgcgttccgcctcccaaacaaattgcatcggaagtggtaacgccgattgtgctgattacactggtaacatagcattggctcacgcgcttacccacagttgcggtaaagttgatgcgtatgccttcattgttgcggttgctgatttttacggcatttgggctgacgcccaaggcaaacgcggcacgttcctgaagtttctagtcggaaacggttacattattgattgagccgcaacctgctaatgccaacgcaacgaacgcagccgaaacgatgatgcgtgtgttcataatttcctcgaaaattaaaaatgaaaacaggaaaacgattcttacgtgaagcagaaaaaatgtcaatagaattatatttcccacttaaaatctggaaagctattctctatatttcagacggtatatcccgcaaaattaaggccggtaatctatgcccaactgctccagcaggtggccgaacgtttcaggcgtatcgaaatacaggacaatcctgccttttttgtggttggcggttttgacttcagcgttgacacccagtttttcagtcagcaaatcattcaggcggccgatgtcggcggcggcagtctttttgggctcgggacgtttgttttgaagggcggcctggctgcggcgttcgacttcgcgcaccgaccagccgtttttgacggccttttgcgccaattcgagctgttcgacgacgggcagggtcagcaatgcgcgggcgtgccccatttcgaggcggcgttggtaaagcatttcctgcacgggttcgggcaggcttaaaaggcgcaggctgttggaaatcgcgcttcggcttttaccgacggcttgggcgatggtttcgtgggtcagcccgaactcgtcggcaaggcgtttcaagccttgtgcttcttcgatggggttgaggttttcgcgctggaggttttcgatcaaacccattgccaatgcggtttcgtcgctgatggttttgataacggcggggatttcggtcaggccggcaatctgtgcggcgcgccaacggcgttcgcctgcaatcagttcgtatcgggacagtccgtgttcgcgcacgatgacgggctgtatcacgccttgcgccttaatcgaatctgccagttcctgcaaggcttcgtcatcgatttgaacacgcgcctgatagcggccgggccggatatctttaaccgcaaccgtggtcaatcggtcgccgctgctgttgtccgcgccgttggcgagcagcgaatccaagccgcgccccaatccgccttttacttttgccataccgccctcccgtgcctattcagataggatgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaaaggacaaaaatgccgtctgaacacggatacagttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttctcggcgatgtccgctttggatgcggtcaacggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgtacatagtcggtaaactcgaccagtttgacggtgtagccttttttctccagctcggcttggatttgttctttgaccatatcgccgaagtcgccgacggtcgtgccgaagacgatttcttttttcgccgcgccgttgtcggcggcggcagaagcggatgcggcgggcgcgctgtctttttgaccgccgcaggcggcgaggatgagcgcgagtgcggcggcggaaagggttttgaagaaggttttcatattttctcctgatgttgtggcagtttcaaacaaaaatgacgggcagggagtcctgccgtccggattcggcgttcagacggcatttgccgcgaacagggggattttatagcatttttcggatagcggtgggggttttggcgttcagacggcattcgggttcaacgtttgtcgagtttccgcgccaacgcgttgccggtgctttgaatcaggatgaccagcagcacgaggagggcgacgatgaagatgatgacttcggtttggtagcggtagtagccgtagcggatggcgaggtcgcccaagccgccgccgcctatcatccctgccgccgcgctgtatgacaaaagcccgatggcaagcacggtaatgctggaaaccatgcccgcgcgcgcttcgttcaagaggactttgcagacgatggcaatcggcggcgcacccatcgcggcggcggcttcaattacgcctttggggacttcgcgcaggttttgttccaccagtcgggcaaaataaaacaatcccgacacgctcaacaccagcgaggcggcaaccggaccgatggtgctgccgacgatggcgcgtgtggcgggtatcatcgcaatcatcaggatgacgaaggggaaggcgcgcatgaggttgacgaggttgtcgagcaggaagttcaccagcttgttgtaatgcagttggcggctggaggttacgaagagcagcacgcccagcagcgtgccgaagatgacggcgaatgtggtggacaagccgaccatcacgaaggtttcgcccaaggcgcggaagatttcgtctttcatgccgacgatggtggaaacggcttgttggaatgttaagtctgccatatcagtcctcccgaatcagttcgcgcccgatgtcggattgggcgtggatttggttgccgcgtacttcgacgatttcgacgactttgcctttatccaagagggcggcgcggtcgcacaggcggcggatgacgctcatttcgtgggttacgatgacgatggttacgttgaagcgtttgttgatgtcttccaaacattccaagacgctgcgcgtggtggcggggtcgagggcggaagtgggttcgtctgcgaggatgacttggggtttgggcgcgagtgcgcgggcgatgccgacacgttgtttctgcccgccggaaagctgggcgggatagtggccggcgcgttcggtcaagccgacgatttcaaggcattctttaacgcgcgctttgattttttcagacggccatccggcgatttccaaaggaaaggcaacattgtcggcaacggtgcggttgctcaaaagattaaactgctgaaacaccatgccgatattctgccgagcctgacgcaatgcggcggcatcgagcgcggtcagctcttgtccgcagacgttgaccttgccgctgtcggggcgttccaacaggttaatcaggcgcaacagggtggatttgcctgcacccgaataacccatcagcccgaagatttcgccgtcgcggatttcgaggctggtcggctcgacggcggcaaaacgggtcttgtcgcgcgtttggtaatgcttggaaaccttgtccaaaataatcattgtctttcccatacaacaaagcccgatgtcggacacaacgggcgcggaagataaagctgaaattgtcggaacgctttagctgttatgcccgcaagctgtgtcaaatcggcaggttaattttcgtaggatattatcgggaaagcatttttttgtcaataaagcaggaagcgggcaaccatttcggacaatgccgtctgaaacgggcaaaggcagcggttcgcaccaaaacggcaaataattgaaaaacatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaattatgtcggaaacattccaaaggcggtgcagtttcggcatataattcgggcaaacgcctgttcagacggcattttgtcttttccaaccctgaccgttcagggttccgattcttaaggaaatccgatgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgccgccctcttcggcgcgccgcacatcccgctcaaacagcgtatgggcattgttcctgcacgctgacgtaccgatgccgtctgaaacccgcccggtctttcagacggcatttttatcccgaacggcattgacggcgaaccataaatataagacaatccgaaaattgtttttcctgctttttcaagcagcttgacacggcacaagccgacccgttaggaggtgatgtttccgtcacggcgcgtatcccgccgccgcaaggcacagcgatacggtaaactttcaacaccgtctgccctaccctttccaccgatatgatgggcagatgaaacaaccgaatttattaaaggaaataaaatgcctgcaatccgcgtaaaagagaatgaaccatttgaagtcgctatgcgccgtttcaaacgcgccgtagaaaaaaccggcctgctgaccgagctgcgcgcccgcgaagcctacgaaaaaccgactaccgaacgcaaacgcaaaaaagcggcagccgtaaaacgcctgcaaaaacgcctgcgcagccaacaactgccgcccaaaatgtactaaacgttcaagtacagattacaggtcagccctgtgatatgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccgacatgggcgaagtcaacaaaatcctgaaagccgtgctgaccgcctgattgcccgaatatcggacaaaatgccgtctgaagcccgtatcgcaggttcagacggcattttcaatatcccaatatcgaatcggcaggggcaacacggttttgatacgccgaaacgggttttgccgataaacagattccgtttgcgccccatcggacaaaatgccgtctgaaacacgattccgttcagacggcatagatttatttgaccaatttcaagccttttttggcgggtcggggcgcggtttcggcagaggtgttttcaggcggcgtatcggggcggtacgcttccaactcaaaccccataccttctccggtctcccgtgcgaaaaggctgaggacgtgtccgacaggtatccatatatcgtgcgcctgtccgccgaagcgggcggaaaagctgatccaatcgttgtcgatttgaaggttttgcgtggcggtcgcgccgatgttgagcataatttcgttgtcgcggacgtactgcatggggacgcgcgtgtgttcgttgacccagacaaggatgtgcggtgtgaggctgttgtcgctgcaccattcgcagagggcgcggaggatgtagggtttggtggaagtgggcataatgggttccgtgttgtacgccaaaataggaaaatgcctgcaaaacggtgggttttgcaagcatttcggacttatttgcgcatggctttttcggcgggtgtcagtgcttcgataaaggcttcgcgctggaagatgcgctcggcgtatttgagcagcggcgcggcacttttgcccagtttgacatcgtagtggtcgagccgccacagcagcggagcaagggcgacatcaatcatagaaaaatcttcgccgaggatgtatttgcttttgctgaacgaaggggcaagcatggtcagaccgttgccgatggcttcgcgcgcttttgcctgttccttgttggtggcggcggggttttctaacacttggacgtggttgaacaattctttttccatacggtacagcaccagccggccccgaccgcgcataacgggatcgccgggcatcagctgcggatgggggaagcgttcgtcaatgtattcgttgatgatattggactcgtgcagcaccaaatcgcgctcgaccagcacgggaacttggttatacggattcatgacggcgaggtcttcgggtttgttgtaaatatcgacgtctttgatttcaaaatccatacctttttcgtacaaaacgaagcggcagcggtggctgaaggggcaggtaatgccggaatagagggtcatcataataattgtcgctcctgtgtgatgcctgcaaaacggctgatttatagtggattaacaaaaaccagtacggcgttgcctcgccttagctcaaagagaacgattctctaaggtgctgaagcaccgagtgaatcggttccgtactatttgtactgtctgcggcttcgtcgccttgtcctgatttttgttaatccactatataaaggtttaatcgcgcaattatacgcgatttccggcacttaatccagaaattcggctcaatctgttgttttttatatattttccccgattttccgtatcagtgcgaacttactgtctttgttgcgcggacgcgcaccctgccaaaccgtctgccagccttgcggcgcatccgcattttggggcaggaggacgatgcggtagcggcattgtacatcgccgacgcggtgcggcaatgtgccgtactgcgtccaaacaatccgcgtgtgcaggtcgccgccgcctatgccgatacactcgatgccgtctgaaagctcccgtttcaattccggggaaagcgatgcctccatactccggacgaccggcgcgtggcttttcgccgcgtccagccacggcaggaacagcgtcatcagcaaagcccaggtcagggtaacgcctgccgcccagttggtaaccgcctgcctgccgcgtatgtttttccgggtaatcgcccacagccacaagggtgtgaacagtacggcaaccgccatcggaatgggatcgatatcaggaacataatacgggctgaaataggcggcgcgttcggcaagcttggcgggccagccgtaattcatggcgaaaaagcccgtccacaggaacacggcaaacagtccgaacgccataatgccgaaccagttgacaaacgccgccgcgccgcgcctcaggctgtccagttgcgccgcgccgaacagggcaagcggcggaagcagccagacgaggttatcctgaaaacgctgcggattgacggcaagcagcaccaaaacggcaagcatccagacgacgcccaaaatcccccagtcggtcgaaaacaggcgcgtgcggcaaaccgtccaaaccgccagcggcagcgcgggcaatgcaaaccaaagcaggtttttcagatagtaaaacaaactgaatgccgtctgaacgtgccgcacgccgccgaacgtaccgaaaacgtgatagtcgagccattgcgcgaacagcgcgggctgcgtttttgccaagagcagcgggtaaacggtcataagcggcagggcaaaggcaagtgaggcgactgccgtcaacatcaaacgcctgctttgccacggacggaaaaacatcagtacgggcaagggcagcatcagggcaaatgctgccggataagctgctgccaacgacatcagcgtccagcccgtaccgagcagaaaagaggcggcaatcacgcgccggcgagccaaagaataaccgtgcagcaccagtccggcggcggcaaaggcggcggcagcggggttgaggaaatgggcaactggaatcagcccgatacagccgatgagaatcaggacgacgctgcgcccgtggtgtctgcccaaaaagttgaaaccggcaaagccgcaggaagtcagtccgataacggcaaaaaatacgcctgcaaagcgtgcggcatcgtatgagtcggcagcccacggcgacagcaaatgtttgaacgcggcggcaacccaaagatacacgggcggtatgccgaaatcggtttgaccgaacagatgggcaaccaagggggtggggctgcctgccagtgcttcgacggcggtatagacggcaggttcgtcaggattccacaaatcgtgggaaaacacgccgggccacaaccaggcaaacgccatcaacagcagcagccacggcttttcgtgggttttggcgggcgggcgggcatcgggcggggtataggtcagcataagcgtgagaaaaaatggacggattgccaagtgtagcaaatattcgcacaaaggtcgtgcagagactgcttcagacggcatcagacacaaaaagaccggcaacaaaaaagactgcacatggcagtctttgcagatactatctttttcataatattttttcctagcccaacacagtccatagcatatcaaaactgttgttttcaaccaggatatatatccccaatcctaaataaacaacagcaacaaaccatctgctatatttttccaaagtttctccaacagaagggacttgtgctaatttttgggcagaaaaaaccaagagataaatcatgactagaaaggtaagtaaagccactatcaaattcgctaaatttaaggtagtaaaatatgggacaaagacaccaatattgtcagcaccacaacttgcaaaagtaatcatagcgactagaaaaatcaggtttttattatctttgcgcaaaccctctttggcaatagcctctccatcagaatctcctaaaagcaaaactttgatgcctaggagaattggaatcaagccgagcaaacctaaaatctctttactaggaatataatctaagacaaatgcaaaaagtaaacttagcaatatcagactaacagagcctagaaattgtcctaaatagatgttaatgatgtcttttctactttttcttttggcaaaaaataacattaggataataagtaagtctacggctgtcccagaatacaggattattgaagtaacgacattttgaatcataaaacatctcattcaaatatatttttaaatgtattcaaacattaaaccttgtagatgtcaacttcaaccccgtcaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatagataagaagtcagtgtgccaaatattaaaaagccctgccatcgaaatgatggcagggcttaattcttgcaaagcggcaatcagcgtttgaacaggttgccgaatttgttgttgaatttgtccacgcggccggtggtatcaacgattttttgggtgccggtatagaacgggtggcacagggagcaaacctcgatattgaagttttctttttccatcgcggatttggttgcgaatttgttgccgcaagagcaggtaacgttgacttcgtggtagttcgggtgaataccttgtttcatttgatttcctttcaaaaaagcgggcataggggatgtacctatgctacagacaagtccgacattctcgctattttctgttgttacgtcaagagtatattcgataaaatgtatagtggattaacaaaaaccagtacagcgttgcctcgccttgccgtactatctgtactgtctgcggcttcgttgccttgtcctaatttttgttaatccactataaaaagttcttttgagggaggtttgatgggatcaaaattctttttcctgctgctgcgttttgccggttcggggttgccgccgtcacatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggagccggaatgtctgttttattcaaataaccacaagtttgaccgttcaaaaaacgctttgagggctacacggaaatccgtccgattacgttggaggacgatgtctggccggggcacagggtgattgtaatggcgggcgtaaccgtcggacgcggttcggtcgtgggcgcagcgcggtggttacaaaagacattccgccctactctttggcggcaggcaatccggcagtggtgaaaaagaatctgccggaaggttgaatgccgtctgaacgtgtcggggcggatgatctgaaaaaacaggaacatcgtttctgttttttgcgcttcagacggcatcgctattgcgccacgcggtatcgatttcttggtagagtttgccgaaatcgggttcgccgacgtaggttttgaggatttcgccttttttgccgataaggacggaagtcggataaacctgtgtgccgaacgcctgtccgacagctttgtccgcatcatacatgacggtaaacggcaaaccgtagtctttgacatattggcggacgctttctatcggatcgatgggctgggcgacggcaagtacttggaagtttttgtttttatagtcatttgccgttttaatgattttgggcatttcgctcacacaacccggacaggagggaaaccaaaaattaatcagggttactttgccttgcaggtcggcgttggaaacggtttttccgtgcaggtcgggcagggagaaggcgggcgcggttttgctgtcggggatgaggacgatggcaaggaggatgccgatcagtgcgacgacggcggcggtgagtatttttttcattcggacaaggcttccaatgcgcgggcaagggtggcgggcaggctgacggtgcgttgtgtggcggcgtggacgggcatcagggtgatgtcggcttctgcggcggttttgccgtttggcagtgtaatcgtctgggtcagcacaatacggcgcgtgccgggggttttcaggcggcatgaaaactgcaatacgtcgccttcgacggcggggcggctgtatcggatgtcgatgcgggcgacaatcagtatgaggcctgccaactcgtgcagcagtccgcgttcttcaaaaaacgcccagcgcgcttcttcgaaaaattcgaggtagcgcgcattgttgacatggccgtagccgtcgagatggtagttgcggacggtcagcttcatcagttcaggttgatgggttggaaggcttcgcgggcaagcggttcgtgttcgaggtcggtgatgacggtagaaagctggatgtcgaaccattcgttgaaaatgtcggcatcgagcgcaggccactcgcgttcgtcttcgcaccagtcggcaagttcggcggcgaaaatgtcttcaaaacgggcttcgatttcgtcccatacttcgtcggcggtttcgcacgggcggacaaggtaggaattggcgtcggcttggatgtcttcaagagtcagtccgtcgaggtggttgcccggcagggtttgcagccagttccaaaaaggttctaaagggatgaggacgaatacgctgcggttgacttcgtacatggtttttcctttgctgtcgcgcggtatgcgcaaaaaagagattatagcccaatctgtggtttcggactgtccgttccgacagaagggaatgccgtccgaacacggattttcagacggcatggctttaaggttgtgttccaggttgcgtttcggcttcccctgctgcttctgcctgtgtttcggatacggaatcttcttgaacggcagtttccgccgcgccggtttcggcactttcgaccaattcgtcgatgtcgatgttatcttccgtaccttcggcaggtgttgcaccggtctgccgcgcacggactttcatatagaggtcgcgcgtgtagctgtatttgtcgatggcggcttcgtccagactgtcggtcaaatcgagcaggccttcgcgcgtactgacggcggatacggcagtcgtgccccagcgtccgacaggggtgcggaagacgatattcttgggcgaataaacggaggtaatacccgtgccgagcgcgtcgcggacggtggacggccctaagacgggcaacacgaaataattgctgtttttccatccccacgaggcaaacgtgtcgcccaaggtgtttttattgtcgggaatgccgcccgcgccggcgatgtcgataagcccgcccaaaccgaaagtggtgttgatgccgacgcggacaaggtcttcgcttgcgcgtttgatgtccaagcgcaagatattgctgccgaagctgaccacgtcgcacaggttgttaaaaaaattggacacgccggcgcggacgggtttcggcgcaactttgcggtagccgcgcgcggcaggggcgaaaatgtagcggtcggcttggtcgttgaatttgaaaacggcgcggttgtagccttcataagggtcggcggggcgggtttcggcaaatgcaggggcggaagcgaacccgatcagcaggaggaaggcataggcggtttttttcatgatttcagccagtctttgatttcgtacagttcggacagcgcgcgcacggattcgggaatgccggtcagcctgacgctgcctttgcaaccgcgcagcacttcgagcagcagcgacacgcaggcggaatcggcgcgtccgacgccgctcaaatcaaccgcgcaggtgtctttcagacgacattgctgtctgaagcgggtaaaagcggcggcggtcagggttttgacggtgatgtcgccgccgatgtgcaatattccgtttttgagttctgtatgcatagcgtttgctcggaaaacccataccgccctcggacggtatggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaaagttccttgaatatccgatgttccgcgtttcgtcttcagacggcctgtcaatctgtaaacatccacgcggtcaatataaaatcgaccgccaaaatcgtcagggcggacgaaaccaccgtgcgcgtgctggcgcgcaaaatgccttccgaagtcgggacgcaatggaagccctgatgcacggcaatcagcgttaccgccacgccgaacgcggcggatttgatcagaccgttgattacatcgtaatgtatcgtgatgttgttctgcatttgcgaccagaaaataccgctgtccaagcccagccaggttacaccaaccaaatacgcaccgaaaatgcccgccacgttgaaaatcgaagccaaaagcggcatggaaaacacgcccgcccaaaagcgcggcgcaaccacgcgggcgacagggtttaccgccatcacattcatcgcttcgagctgttcggtcgttttcatcagaccgatttcgctggtcatcgcaccgcccgcgctgctggcaaacaaaatcgctgccaataccggacccagctcgcgcaatagcgaagccgcgaccatatagcccaaaatatcggcggatttgaatttcgacaactgcgtatagccctgtaaacccaagaccatgccgacaaacagccccgaaacggcaacaatcaacaccgacagcacaccggcgaaatacacttggcgcacgctcaggcgcggacggacgaaagccgtaccggacttcgccagaatgttcagcagaaacagcgtgatactgccgagggattgaataaggccgagggttttcgccccgacggaacggataaagttcataaatttctatgtgtaaagttcaacggtttcagacggcatcaactcatttatcccaacaggtcctgctgcaacgacgtttgcgccggataacggtatgctacggggccgtctgccagcccgccgacaaactggcgcacccaaggcgaatccagttcgcgcatttcctgcggcgagccggagaacataatttcgccgtgcgccaagaaaatcacctgatcgacgatttccaaagatttttcaatgtcgtgcgttaccataatactggtcgaacgcaaagccttgttgacgcggctgatcaagtgggcaatcacgcccaaggaaatcggatcgaggccggtaaacggctcgtcgtacaacataatttcagggtcgagcgcaatcgtgcgggcaagcgcgacgcggcgcgacatcccgccggacaactcggacggcatcaggttttccacaccgcgcagaccgaccgcgttcaatttcaacaaaaccaaatcccgaatcaccgcttccggcaggcgcgtcagttcgcgcatcggaaaagcgatattgtcgaataccgacaaatcagtaaacagcgcgccgtgttggaacaatacgcccatacggcggcggtgttcatacaactcgtcagccgaaaagcccgccaaatcccgtccttcaatcaaaacctgcccggactgcggacgaatctgtcctgtaatcagtcgcatcagcgtggttttgccgctgcccgaaccgcccattacggcagcaaaattgccttgcggaatgctgaaattgatgttcttcagaatcgggcggtcgccatacgcgaaggcgacgtctttcatttcgataaagggggatgggctcatgtacggacggacggtaggtttgacggcgtgtattttaaggcttatcgggaagacgggcaattttcagacggcatacggacggtaaatgttgtgaaaatgccgttgtcggcggcggattgtttgctgtggcgaaaaatgttatctttcaaatgataacctttatcagaaaactatggaaaaagcagaacatttgaacagcagccggttcgtcaatctagtcaaaagcggcggcggcagctatgtggagggcagctaccgtttcgatactttgtccaacggcatttccatccacggcggcacagtaacggcacggtgtgatttttgcagcagccgcctcgccgaaccttatgtgtcgttcgtgctcttgctggaaggcagtttggacttcggcatcaaccgctgccgcttccaaatcgatgcggacggcggcaagattgtcctaattgctgtcggggaagaagtcctgttcagccgctatctttaccgaggcggcaaaacggtcaaaatgaccattaaaggtatggaacaatggctgctgcgtccggaatacgcgcgtttcgcacccctgctttaccgcgaaccggtcaggatatgggatttgcccccgaacctgcgcggcttggcggcatcctgcctgaaagccgtcccaaaggggcatttgggcgaaacattgcgccgcgaggcggacgtgttgcggctgctgtcggacttgtgggacacggtttcagacggcatcgggccggcggcggggcaaacggcggaagcagacgctatgccgtctgaagacttcagccgcaccctaaatgccgcgtttgccgacggcgcacaccaagtcaaccggctgacagacgcgctgaacatcagtgaaaggacgctgcaacgccgtatgcgcgaccatttcggcattacggcaagcgaatggctgcaccacaaacaaatgcagcacgcgctctatctgttgcaaaacgggggaaaaagcataggcgaaaccgcatatttatgcggctaccgccacgtttccagctttactcaggcattcaggcaatatttcggcagcacgcctgcggaaaccaaaaaagaaaaccggtaagccgcatttgatttcaaacccgaaatccgcgtgtatagtggattaacaaaaaccagtacggcgttgcctcgccttagctcaaagagaacgattctctaaagtgctcaagcaccaagtgaatcggttccgtactatttgtactgtctgcggcttcgtcgccttgtcctgatttttgttaatccactataaaaaacttgtacggcaatttatttgggaataaactaaaactacatctaactacaaaactggagaacccgaaatgaaacaattggccatgtacatcaacggacgctttgaaaacgatttcaacggcgaatggcgcgacgtattgaacccgtccaccgaagaggccatcgcccgcgaacccaaaggcggcaaggcggacgttgaccgcgccgtcgcggcggcgcgtgcggcgcaaccggcttgggagcgtctgcctgcggtcgaacgcggcgcgtatttgcgtaaaatcgcccaaggcatacgcgaacgtgccgacgagctgaccgacaccatcgttgccgaaggcggcaaaaccaaagacttggcacgcgtggaagtcatgttcaccgccgactatctcgattatcaggccgaatgggcgcgccgctacgaaggcgaaatcatccaaagcgaccgcccgcgcgaaaatattttattgttcaaacgtccgctgggcgtaattgccggcattttgccgtggaacttccccttcttcctgattgcccgcaaaatgggccccgctttggtaacgggcaacaccatcgtcgtcaaacccagcagcgtaaccccgatcaactgccacatcttcgccgaaatcgtcgatgcggtcggactgcccgcaggcgtgttcaacgtggtgaacggtcccggcgcggaaatcggcaatgccttgtccgcccatccgcaagtcgatatggtcagcctgaccggctccgtcgaagcaggccgccaagtgatggaagccgcctccgccaacatcaccaaagtttcgctggaactcggcggcaaagcgcctgccatcgttttgaaagatgcggatttggacttggcggtgaaatccatcttggcttcgcgcgtcggcaacaccggtcaaatctgcaactgcgccgagcgcgtctatgtccacagcagtctgaaagacgcattcattgaaaaaatgaccgccgcgatgaaaggcgtgcgctacggcaaccctgccgaagccgaagcaggcgcgctggaaatgggcccgctgattgaagaacgcgccgtcaaagccgttgccgaaaaagtggaacgggcagtcaaacaaggtgcgaaattggtttgcggcggcaaacgcgccgaaggacgcggttatttcttcgagccgaccctgctgaccgacaccgacaacagtatggacattatgaaagaagaaaccttcggccccgtgctgcccgtttccgctttcgacacgctcgaccaagtcatcgccttggcaaacgattgcgagtttggtctgaccagttctgtttatacgactaatttaaacgaagccttctacgttacccgccgcctgcaattcggcgaaacctacatcaaccgcgaaaactttgaagcgatgcagggtttccacgccggttggaaaaaatccggtatcggcggcgcggacggcaaacacggtttggaagaatatctgcaaacccaagtcgtttatttggaaaccgacatttaatgccgctttaaaaccccgatagaaaatgccgtctgaacccgttttcaggttcagacggcatttttattgcttcaccggcaatcagtcatgaccgaggtcgatgtttttgtctttgtatagtggattaacaaaaatcaggacaaggcggcgaagccgcagacagtacaaatagtacggaaccgattcactcggtgcttcagcaccttagagaatcgttctcttcgagctaaggcgaggcaacgctgtactggtttttgttaatccgctatattccgccatctctaagatttacagcgatacacgggtaatttaaggaatgcccaaaccgtcattcccgccacttttcgtcattcccgcgaaagcgggaatctagaatctcggactttcagataatctttgaatattgctgttgttctaaggtctagattcccgcctgcgcgggaatgacaaatccatccgcacggaaacctgcaccacgtcattcccacgaacccacatcccgtcattcccacggaagtgggaatctagaaataaaaagcaacaggcatttatcggaaataactgaaaccgaacagacctagattcccgcctgcgcgggaatgacggctgcagatgcccgacggtctttatagcggattaacaaaaatcaggacaaggcgacgaagccgcagacagtacagatagtacggaaccgattcacttgttaaagaatcgttctctttgagctaaggcgaggcaacgccgtactggtttttgttcatccactataactagggaaattcaaattaagttagaattatccctatgagaaaaagccgtctaagccggtataaacaaaataaactcattgagctatttgtcgaaagttcaaatttccattttaaaacaattagtaaaatcgagtttatcctagttgtccaagacaacccctataataatataattcaaaatataaaaatgggttacatctaaacattacggaatttttattccctcgcctgaattctattgtcagattcaaggagacctcatcatgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgccccccccccgaatctgcataccggagactttccaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctgaagacggaggcggtaaagacattgaagcttctttcgacgatgaggccgttatagagactgaagcaaagccgacggatatccgccacgtaaaagaaatcggacacatcgatttggtctcccatattattggcgggcgttccgtggacggcagacctgcaggcggtattgcgcccgatgcgacgctacacataatgaatacgaatgatgaaaccaagaacgaaatgatggttgcagccatccgcaatgcatgggtcaagctgggcgaacgtggcgtgcgcatcgtcaataacagttttggaacaacatcgagggcaggcactgccgaccttttccaaatagccaattcggaggagcagtaccgccaagcgttgctcgactattccggcggtgataaaacagacgagggtatccgcctgatgcaacagagcgattacggcaacctgtcctaccacatccgtaataaaaacatgcttttcatcttttcgacaggcaatgacgcacaagctcagcccaacacatatgccctattgccattttatgaaaaagacgctcaaaaaggcattatcacagtcgcaggcgtagaccgcagtggagaaaagttcaaacgggaaatgtatggagaaccgggtacagaaccgcttgagtatggctccaaccattgcggaattactgccatgtggtgcctgtcggcaccctatgaagcaagcgtccgtttcacccgtacaaacccgattcaaattgccggaacatccttttccgcacccatcgtaaccggcacggcggctctgctgctgcagaaatacccgtggatgagcaacgacaacctgcgtaccacgttgctgacgacggctcaggacatcggtgcagtcggcgtggacagcaagttcggctggggactgctggatgcgggtaaggccatgaacggacccgcgtcctttccgttcggcgactttaccgccgatacgaaaggtacatccgatattgcctactccttccgtaacgacatttcaggcacgggcggcctgatcaaaaaaggcggcagccaactgcaactgcacggcaacaacacctatacgggcaaaaccattatcgaaggcggttcgctggtgttgtacggcaacaacaaatcggatatgcgcgtcgaaaccaaaggtgcgctgatttataacggggcggcatccggcggcagcctgaacagcgacggcattgtctatctggcagataccgaccaatccggcgcaaacgaaaccgtacacatcaaaggcagtctgcagctggacggcaaaggtacgctgtacacacgtttgggcaaactgctgaaagtggacggtacggcgattatcggcggcaagctgtacatgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctgacggacaggaagcagacagccgcaaagatcacggtctttgcggctgtttcttatgaaaagaaaaccctattccaattgcctgcttctattgtttcaagacttcttccaaagattcggcattaatcagatgtatagcggattaacaaaaatcaggacaaggcggcgaagccgcggacagtacaaatagtacggaaccgattcactcggtgcttcagcaccttagagaatcgttctctttgagctaaggcgaggcaacgccgtactggtttttgttaatccgctatattccaccatctctaagatttacagcgatacacgggtgatttaaggaatgcccgaaccgtcattcccgccactttccgtcattcccgcgaaagcgggaatctagaatctcggactttcagataatctttgaatattgctgttgttctaaggtctagattcccgcctgcgcgggaatgacgaatccatccgcacggaaacctgcaccacgtcattcccacgaacccacatcccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagacgcagacagtacagatagtacgaaaccgattcactcggtgcttcagcaccttagagaatcgttctcttcgagctaaggcgaggcaccgctgtactggtttttgttaatccactatacttggagctggtcttgcttttcgcctaattctacgttttcaaacggttgcagctggtggtctgccataaaggtctccttattgtatttcaggttggaaatcggaatttgttttcacaattttacaccttcgcccccgctttctctacataaaattacattttgccgatatttgccgaattgtctgaaaatatgtgtaataaggggcgtataatcaaaacatttgccccggattgccatgccttatttcgccctgtttgacgatgccgtaagcggccgcgcaaaacgctatcaaaatcatgtggaaagccgttttttccgtcccgaagaactcgatgctttggacggcgcgctgcaatcgggctggcaaaaagggctgcattcggtgttgtttgcagactacggattcggtttgccgctgacgggggttgagtccgaacgcggcggcaatcttgccctgcactggtttgccaactgcgccgacatcgatgccgaaagctggcttgcccgacactcagacggcctccccgccggcatttccacgccgcaaccctccgtatccgaaaccgattacctcgaccgcatccgccaaatccacgaagccatccggcgcggcgacacctatcaaatcaactacaccacccgcctgcacctgcaagcctacggcaatcccgtcagcctctaccgccgcctgcgccagcccgtcccctatgccgtcttgtcccacctgcccgatgcggaggggcaatccgcgtggacgctgtgtttctcgcccgaactcttcctcaaaatcggttcggacggcaccatcagcaccgaaccgatgaaaggcaccgcgccgattttgggcgacggacaagacgaacgccgcgccgccgagttgcaagcagacccgaaaaaccgcgccgaaaacgtgatgattgtcgatttgctgcgtaacgatctcggcaaaatcgcccaaaccggcacagtatgcgtacccgaaccgtttaaagtatcgcgtttcggcagcgtttggcagatgaccagcaccatccaagcccaagccttgccgcacacctcgttcgccgacatcctccgcgccgccttcccctgcggcagcatcaccggcgcgcccaaaaaaatgagtatgcagattatcgaatcgctcgaagccgaagcgcgcggactttatacgggcagcatcggctatttgaacccgtgttccggcggcttggggtttgaaggcacgttcaacgtcgttatccgcaccttgtcgctcacgccgctttcagacggcatttatcaaggcgtgtacggtgtcggttccggcatcgtcatcgacagcgaccccgccgccgaatatcgcgaatgcggctggaaagcccgtttcctcaacgaattgcgccccgacttcggcatttttgaaaccctgcgcgcggaaaacggacgctgcaccctgctcgaccgccacctatgccgtctgaaaacctccgcccaagccctcaacctgcccctgcccgacggctgcgaaaatcaaatcaaacaatacattgccgacttgcccgatggcgcgttccgcgtcaaagccctgctcgcttcagacggcatcagcctgtcccgcgccgttttaaaccgtctgaccgacaaacaacgcgtcatcatttcgcccgccgtcctgcccgcacaaaactacctgcgccgcttcaaaaccacctgccgcgccctcttcgaccaagcgtggcaaaccgccgaaacacaaggcgcgttcgacagcctgtttttcaattcagacggcatcctgctcgaaggcggcagaagcaacgtcttcatcaaacatcgcggacaatggctcacaccctctttagatttagacattttaaacggcataatgcgccaagccgtattggacgaaccgcaaaaatatttgcaaacaaatcaagtaatcgaaacacacatcacacaaaaaacactgcaagaagccgaagaaatccgcctctccaacgccttgcgcggcgtatttgccgccgcccttgcctgaacgcgcaaaaatgccgtccgaacctgtttccaaagttcggacggcattatcccaccattcaaaaccgccaatccgccgacacaaacacctcgctgttgcggcgtttcgcatacggcacattactttccgtcctgccgaaacgataattcaacgccggcacgatacctttgtacgacaacttgtcgtggctcaaagccagcgagacattccattcgcggttgcgttgcgcctctgtcgagaaagccgcaatgcccttatagttgcggcgggcataagacgcggaaacccgactgttcaaaccgcccaactgccgccactcctgcgcccaaccggcataaacaccgttgcgccggtaggcggcattattgaccgcgccgcccaccgtttcgcgtttcggcacaaaccgcacaaactgccagccgccgaacacagttgccgattcgcccaaacgttttgccgacgaaacataaaacccgtcctgcctgccgttattgtattccgccctatcctgttcgcggtagcgttggcggtaatgttccagcgcgaccgaaaattgccatcccgggtttgggcggtaagtatgggacagctgcacgccgactccgtgcgccagcatatacggcggcaggcggcggttgtttacccgttttgttttcgcatcaaagccgtcgctgcccgacaactgcacctgataaaacggcaaaatccccgccgtctgccgtgcatttttatactgccaacccaaatacgccctgccgaacccgtcatcataagctgattttttactgaaataatagctcgtgccgccgatattggaacggaacaacaaataatgattatctgccaacggcgtcagcttttccgcctcgatttcataattcaaccctgccgcccgctccgcccggctgacactgcatatctgccggcctccgttttgccggcaatattgcggcgcggcattattggcatttctattgaccgccggactgatgccgcccgaaaaacgccagcccgtcagcccctccgtttttttccgaaaacgccccacattttccaaaaccggtgccggcaaatccaattttgccgcctccgcaaaatgcctttctgccgacttcagccggaaatcgtcaaactccgccgccgccaaatccagcaaaatccgctcgtctgccgcattttccccgtgcagttcccgataccgcgccaccgcctccgccggccttcccgccaatttcgccagcaaagcccgcgccctgccgtacaaaaccgcgtcataatccggcagcttggcatacaaatccgccaacgaagcgattaaatccgcctgattgccgttgagcgcgtcgcgcaaactatgttccaacattttcggatgcgccaacaaaaaatccccgtcaaccacgcgcggggcatcattttcaactttccaatctgattccgcccacttatccgacaccgaccgctgcacctgcaacaatgccttgtcatccaaaatcgcgggcgcatccgccccataggcggcagaaacacctgccgcacaccaaacaaccaaaaagccgtatctgaaatacaacataccctgtcatttacctttctggcaaacacgccgccgaagcacgtcaaaccatccgaaaaacaggcagaaacccgtgaaaaccggctttgccgcctgaaagcaggcaaacaaaaaccgccgcccgattttcaaagggcggatttcacatttatagtggattaacaaaaatcaggacaaggcgacgaagccgcagacagtacaaatagtacggaaccgattcactcgtgcttaagcaccttagagaatcgttctctttgagctgaggcgaggcaacgccgtactggtttttgttaatccactataacagcaaccctgtcgccgtcattcccgcaaaagcgggaatgacgaagctatccgcacagaaacctgcaccacgtcattcccacgaaagtgggaatccagaacgtaaaatctgaagaaaccgttttatccgatacgtttccgcaccgacagacctagattcccgctttcgcgggaatgacggcggaaaggttgctgtttttccgataaattcctgccgctcttcgtttttgggatggcgggaaataaaacaaaagcgcgcgtatcaaaaaacaaaaatgcaaagaacggcgttggcaattttaaggtttgcgccttagccgcacttattcgcaaaaaaaaccgcacggcgttgaccgtgcggttttttatctgaaagcttcagacggcattgcttacatcatgccgcccataccacccatgccgcccatatcaggcacagccggtttgtcttcggggatttcagcgatcatgcaatcagtggtcagcatcaagccggcgatagatgcggcgtgttgcagcgcagaacgggttactttggcggggtcgagtacgcccatttcgatcatatcgccgtattcgccgctgccagcgttgtaaccgtagttgcctttgccttccaatactttgttcacaaccacgctgggttcgccgcctgcgttggcaacgatttggcgcagcggagactcaacggcgcgcaagacgatttgtacgcctgcgtcttggtcggcattgccggtgtgcaggttttccaaagcagcacgggcacgcaacagggctacgccgccgcctgcaaccacgccttcttcaacggctgcgcgggtagcgtgcagcgcgtcttccacgcggtcttttttctctttcatttcgacttcggtcgcggcaccgactttgatgactgccacgccgcctgccaatttagccacgcgctcttgcagtttttctttgtcgtaatcgctggttgcggtttcgatttgttggcggatttcggcaacacgcgcttcgatttgggctgcgtcgccaaagccgtcgatgatggtggtgttttctttaccgatttcgatgcgtttggcttgacccaagtcgtccaaagtcgctttttccaaagacagaccgacttcttcggaaatcaccacgccgccggtcaggatggcgatgtcttgcaacatcgctttgcggcggtcgccgaagccaggggctttgacggcaacggttttcaggatgcctcggatgttgttcacgaccaaagtcgccaaggcttcgccttctacgtcttcagcgataatcaacagcggacggctggcttttgccacttgttccaaaacaggcagcaggtcgcggatgttgctgatttttttgtcgaacaacaatacaaacggattgtccaaagcagcgatttgtttttccgcatcgttgatgaagtaaggagacaggtagccgcggtcgaactgcataccttcaactacgtccagctcgttttccaaagacttgccgtcttcaacggtaatcacgccttctttgccgactttttccatcgcttcggcgataatcgcgccgacttgttcgtcggagttggcggaaatagagccgacttgggcgatttctttagaagtgtcgcaaggtttggcgatgtttttcagttcgtcaaccaaagcggcgacggctttatcgataccgcgtttcaggtcggtcggattcatacctgcggtaacatatttcataccttcggcaacgatggattgcgccagtacggtggcggtagtcgtaccgtcgcctgccacgtcgttggttttggacgcaacttctttcaccatttgcgcgcccatattttcaaacttgtctttcagttcgatttctttggcgacggttacgccgtctttggtgatgtgcgggccgccgaatgcgcggtcaacgactacgttgcgacctttggggcccaaggttacgcggacggcgtttgccagaatgttcacgccgtttaccattttttgacggacttcattgccgaactgtacgtcttttgctgccatttcaattctccaaaaatcattaaaactgtctgataaaaccgtttatgccgtctgaaggcggtttgccgtttcagacggcatcgtgtccgtatttatttttcaacgatgccgaaaatatcttcttcgcgcattaccaacagctcttcgccgtcggcttttacggtttggccgctgtatttgccgaagatgattttgtcgccgactttgacatccagcggacggcggctgccgtctttaccgattttgcccgcgcccacggcgatgacttcgcccatatcgggtttttcggcggccgcacccggcaaaacgatgcccgatgcggttttttcttcagcttccaagcgtttgacgacaacgcggtcgtgtaaaggacggatggtcatatttatgctccgataaaatagtttgaaaacaatcatctgcccgaacggttcaggcagattgaagtggaaaccggacagccgtcaagcagctgcccgtataagtcggcaaaattagggtgtgtgcgggtaaattcaagtgaggcggaaaaaatttatttccgccgttttttatagtggactaaatttaaggggctgtactagattagcagatatgttaccctcgaaatatgaagataacgcactgcaaattaaagaaaaaagtacagaaagaactgctccgttttttgtactggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggtagacgtggtcgcggtgcagcaggaaaagtggttgtcttcggcattctgaaacgcaacggacgggtctataccgttgtggtggataatgccaagtctgaaacgttactccctgtcatcaagaagaaaatcatgccggacagtattgtttataccgatagtctgagcagctgcgacaagttggacgtgagcggtttcatttattaccgcatcaaccattccaaggaatttgcagaccgtcagaaccacattaacggcattgagaatttttggaatcaggcaaaacgtgtcttgcgaaaatacaatggaatcgatcgtaaatctttcccgctgttcttgaaagaatgcgaatttcgatttaacttcggcacaccgtctcaacagcttaaaatcctgcgggattggtgtgggatttagggctaatctagtacagcccctaaaatttttcgttttcaagccttcaccgcttgccatcagcgttaaatttttttacgataagcacatagattgtaaacaatcggccacaagccggtttgttttttcagaagacattatccctgtcagacgctatttctatatatttcgcctataatggcttgtttttaataaataattcaagaggtatcaacgtgtctgattccaagacgaaagaacgcgccacattcggcacgcgccgcgcgtttatgattgccgccatcgggtccgccgtcggcttgggcaatatttggcgtttcccctatattgcttttgaaaacggcggcggcgcgttcatcctgccctatctggtcgcgcttctgacggcgggcatcccgctgctgctgctcgattatgccatcggccaccgttaccgtggttctgcgcccttggctttccgccgcctcggacgatggtttgagccggtcggctggtggaacgtgatgaccaatatcgtcatctgcatctattacgcggtaattatcggttgggcggcaagctatacctattattcggtcaacgccgcctggggtgcggatccgcagggttttttctttaaggacttcctgcaaatggcgggcccggaagccttgggtttggattttgtcggcaaagtcgccggtcctttggcgggcgtgtgggtttttaccgccgccattatggcgttgggcgtgcaaaagggcgtggcgcgcgcctcgtcgttctttatgccgctgcttttggtgatgtttttgattatggtcggcatttcactaaccctgccgggtgcggcaaagggcttggacgcattgtttacgcccgactggtcgaaactcgccgattccaaggtctgggtggcggcatacgggcagattttcttttcgctttccatctgcttcggcattatggttacctattcttcttatttgaagaaaaaaaccgacttgggcggaacggggctggtggtcggttttgccaacagcagctttgaactgctcgcgggcatcggcgtgtttgccgcattgggctttatggcgcaggcgggcggtaaggcggtcaacgaggttgcctcaggcggcatcggtttggcgtttatcgcctttccgaccattatcaaccaggcaccgatgggctggctgatcggcatattgtttttcggttcgctggtgttcgccggcgttacgtcgatgatttccatccttgaagtgattgtggcggcgattcaggacaagctgaacatcgggcgcgtcaacgccacgctgctggtctgcattccgatgggcattgtttccacgctgctgttcggtacggcgacggggctgccggttttggacgtgatggacaaattcgtcaacacctacggcattgttgccgccggctttgtttatgttgccgccatcatcatcagcggcaggctgccggaattacgcaagcacctgaacgctttgtcctccatccgcatcggcggcttgtggacggtctgcgtcgtggttaccgtcgtgatgctcggctatatgctgtttaaagataccagcggcctgatggagaaaaattacgaaggttatccggatggtttcctcagtattttcggctgggggatgtcggcggcgttggtcgtgttcgggctgctgctgtcgttgctgccttggaaacacggtcaggatttcaacgtcaaagacgaacacgaacatgaacaaggagaagaaaaatgagtacttccgccattgtgatgatgattgtctcaatcgtgataatctggggagggctgctgctttccctgttaaggctgccgaacgagtaagcctttagagcgttaaaaatgccgtctgaaccgcttcagacggcattttgatgttcggcttgcaggcaggcgagttcgtttgccatttgctgttccaaggtttcgcgccggcggatgagtcggtattcgttgccgtccaccaacacctctgccgcacggttgcgcgcgttgtaattgctcgccatactggccccgtatgcgcccgcgctgcggataagcagcaaatccccttcttcgcaggcgatggtgcggtctttgccgaggaagtcgccggtttcgcaaatcggaccgacgatgttggcggtcagcgtcgcgatgtctttggtttcgaccgcctcgatgtgatgataggcatcataaagcgccgggcgcatcaaatcgttcatcgccgcatcgaccatcacaaagtttttctcttcgccgtatttgacaaactcgacgcgtgtcagcagcgaacctgcgttgccgaccaggctgcggccgggctcaagaatgagtttcagacggcgtgtgccgatcagtttttgaacggcttgggcatacgcgcccaaatcaggcacattttcgtcttggtaaacaatgccgacgccgccgcctaagtctaaatgttccaaaacaatgccttcggcggcaagcgcgtcaaccaaaatcaaaatgcgctcgcaggcttcgaccagcgggcttaagtcggtcagttgcgaaccgatgtggcagtcgatgccgatgattttcaaattgggctgttgtgcggcatagtggtaggcttcgagcgcgtcggcgtaggcgatgccgaatttgttggctttcagacctgtggagatgtagggatgggtttttgcatcgacatcggggttgatgcgcagggagacgggcgcggttttacccaaacgtgcggcaactttctgaatacggtcgatttcggggatgctttccatattgaagcatttcacgcctgcattcagcgcgaactcgatttccgcctcgcttttgcctacgcctgaaaatatggtttttgccgcgtcgccgcctgccgccaaaacgcgtgccaattcgccgccggacacaatgtcaaaaccgctgcccagcgaggcgaagtgtttgataatgctcagattgccgtttgccttgacggcgtaacagacgagcgggttcaaagcggcaaacgcggtttggtagtgttcaaatgcttcggtcagcgcggattggctgtacacataaagcggtgtgccgaatgcttcagcaaggcgggggtaggggacttgttcgcaaaatagggtcatgttttcgttttcatttttgggtttgtggagcggattgcggtttgctttgaagttgcaaaccggtttggattacgccgaaacgcgccttgtcgccttctttgggcaggtagaggtcgcctttgtaaccgcaggccgagagcaggagggcggttgccgccgcaaaaaatacgccgtatttcatcggtaaacttccttcataagcgcgaatgtggcaagattcggcatcttaaacaaaaaacacgcaaaaagctatgatgaccgaaagcgagtttatccgcgcgagcgaagcattatttgaacacatcgaagaccaaatcgacgaaaacggctgggatttcgactgccggtttgccggaaacgtcctgaccatcgaagccggagacggcgcccaaatcatcgtcaaccgccacacgcccaatcaggaattgtggattgccgcaaaaagcggcggctaccatttcgccgagcaaaacggcaaatggctggcaacgcgcgacggacgcgatttttatgacgttttaaacgaagccctgagcgcggcttcgggcgaagcggtggaaattgcggaattgtgatttgggtgttatcacggaaagaaaaaatgaacacacgtcccttttatttcggactgatatttatcgcgattatcgctatacttgctaactatttaggaaacactgatttttcccatcattatcatatcagtgctttaattattgctatcttgctgggaatggcaatcggcaataccatttatccgcaattttcgacacaagtggaaaaaggcgttttgtttgccaaaggcgcgcttcttcgcactggcattgtgttgtatggttttcgcctcacttttggcgatattgccgatgtaggattaaatgcggttgtcactgatgcaatcatgctaatttcaaccttcttttttaccgcacttttaggcattcgttatctaaaaatggataaacaattggtttatctcactggggcaggttgcagcatttgcggtgcggcagcagtgatggcggcagagcctgttactaaagcagaatcccataaagtttcagtggcgattgccgtagtggtcattttcgggacgcttgctatttttacttaccccttgttctacacgtggtcacaacatttaattaacgcccatcaattcggtatttatgttggttctagtgtacacgaagtggctcaagtgtatgcgattggggaaaatattgatcctatcgtggcgaatactgccgtcatttccaaaatgatccgagtgatgatgctcgccccctttttattaatgctttcttggttattaacacgtagtaatggagtatcagaaaatacatcacacaaaattacaattccttggtttgctgtactttttattggtgttgccatttttaattcttttgatttattaccaaaagaactcgtgaaattattcgttgaaatcgattctttcttattaatttcatcaatggctgcgcttggcttaacgacgcaagcaagcgcaatcaaaaaggcaggattaaaaccgtttgttttaggaatactaacttatttatggctagtggttggtggatttttagtgaactatggaatatcaaaattaatataaaattcactaaagagagcgttacccaatggcacaattaccgctatatctgacttctgaaatcaaagactttactgtcggcacgcctaaagttttagaatcattttccaaacatatcccttatggtgtcgtctttgaagacgacggcgacacaggctacttctatgccgcttcgcaagacgggattttagatgccttgcacatctataatgtcgaagatgtatccgacaaacatatccccaatcatgtcttgattttatgggatgatgcctgcaccatagccgcattgtgtatcaacgactacattcatgccgtctatgattttgtcgaacaggcaggatattgccgcaacggcttccctgaagcaggcggcgaatgggtgaaagtcgaaaaccgcgtcttggatgatgaattgctggacaaaatcctatcccgaaaatctacataaccctcacaaaaggatacccaaatgcccctactagacagtttcaaagtcgatcacacccgtatgcatgcccccgccgtacgcgtggcgaaaaccatgactacgcccaaaggcgacaccattaccgtgtttgacctgcgcttttgcgttcccaacaaagaaatcctgcctggaaaaggcatacacacgctggagcatttgttcgcaggttttatgcgcgaccacttgaacggcaacggcgtggaaatcatcgacatttccccgatgggctgccgcaccggtttttatatgagtcttatcggcacgccttccgaacagcaggtcgccgatgcgtggctggcttcgatgcaggatgttttgaatgtcaaagaccaaagcaaaatccccgagttgaacgaataccaatgcggcacttatcaaatgcactcgctcgccgaagcgcagcaaatcgcgcaaaacgtgttggcgcgcaaagtggcggtgaacaaaaatgaagagctgacgctggatgaagggctgctgaacgcctaatccgccaaaaatgccgtctgaacaagggtttcagacggcatttgccttttccgttataatccggggttgtccgggggcgggttttaagccggcatcgtccttccctatttttttctgtcccttatcggttttaagcgggttttttatgtccaacagacctacactcctcctcgttgacggatcgtcctacctctaccgtgcgtatcacgcgatggggcaaaacctgaccgcccccgacggcgcgccgacgggtgcgctgtatggtgtattgaatatgttgcgccgtttgcggtcggaatatccgcacgattattgcgcggtggtttttgatgcgaaaggcaaaaatttccgccatcaaatgtttgaagaatacaaggcgacgcgcccgccgatgcccgacgatttgcgcccgcaggcggaagcactgccggatttagtgcgcctgacaggctggccggtattggtgattgggcaggtggaggcggacgatgtgatcggcacgctggcgaaacagggggcggaacatggtttgcgagtcattgtttcgaccggcgataaggacatggcgcagttggtggatgagcgcgttacgctggtgaacacgatgagcagcgaaacgctggacattgaaggcgtgaaggcaaaattcggcgtgcgccccgaccaaatccgcgattatctcgcgctgatgggcgacaaggtggacaacgtgccgggcgtggaaaaatgcggcccgaaaacggcggtgaaatggctggaagcctacggttcgctggctggtgtgatggaacacgcttcggaaatcaagggcaaagtgggcgaaaacctgcaagccgcgctgccccaactgccgctgtcgtatgatttggtcacgattaaaaccgatgtggacttgcacgccgagctttcagacggcatcgaaagcctgcgccgtactacgccgaaatgggcgcagctggttgtcgatttcaaacgctggggcttccgcacctggctgaaagaagcggaatcaaacatgaataccggctcgaccgatgatttgttcggcagcgacagcatcggcgagcaggcggctttgaatgcggaaatgccgtttgaaaaacaagccgaaaaagccaccgcccccgaaaaactggattatcaagccgttaccaccgaagcgcagtttgccgctttgttggacaaactgtcgcgggcggacacaatcggcatcgatacggaaaccacgtcattagacgcgatgaacgcctcgctggtcggcatcagcatcgctttccaagcaggcgaagcggtttacatccccgtaggacacagcctgaccgccgcgcctgaacagcttgatttacaagacgtattaggccgtctgaaaccgcatttgggaaaccccgccctaaaaaaaatcgggcaaaacctcaaatacgaccaacacgttttcgccaactacggcatcgccctgaacggcattgccggcgacgccatgctcgcttcctacatcatcgagagccatctcggacacggcttggacgaattgtccgaacgctggctcggcttggaaaccattacctacgaatcgctgtgcggcaaaggcgcgaagcaaatcggttttgccgatgtcgccatcgggcaggcgaccgaatacgccgcccaagacgccgatttcgccctgcgcctcgaagcgcacctgcgcgcgcaaatggacgaaaaacagcttgaaatgtatgaaaaaatggagctgcccgtcgcgcaggtattgtttgaaatggaacgcaacggcgtgcaaatcgaccgcgccgaactcgcccgccaaagcgcggaactcggcgccgagctgatgaagctcgaacaggaagcctatgccgccgcaggccagccgttcaacctcaattcgcccaaacagctgcaagaaatcctgttcgacaaaatgggcatccccaccaaaggcctgaaaaaaaccgccaaaggcggcatttccaccaacgaagccgtgctcgaacagctcgcgcccgactaccccctgcctaaaatcatcctgcaaaaccgcagcctggcgaagctcaaatccacctacaccgacaaactacccgaaatgatttcccccaaggacggccgcgtgcataccacctacgcccaagccgtcgccattaccggccgcctcgccagcaacaaccccaacctgcaaaatatccccatccgtaccgaagaagggcgtaaagtccgccgcgcctttaccgcaccgcaaggcagcgtcatcgtttccgccgactattcccaaatcgagctgcgcattatggcgcacctctccggcgacaaaaccctgattgccgcgttccaaaacggcgaagacgtacaccgccgcaccgccgccgaagtgttcggcactgcgcccgaaaacgtctcgtccgagcaacgccgctatgccaaaagcatcaacttcggcttaatttacggtatggggcaatacggtttggcaaaatcattgggcatcgacaacctttccgccaaaaactttatcgaccgctacttcgcccgctaccccggcgtcgccgaatacatgcagcgcaccaaagaacaagccgccgcccaaggctacgtcgaaaccctgttcggcagaaggctctacctgcccgacatccgcaacaaaaacgccaacgcccgcgccggagccgaacgcgctgccatcaacgcccccatgcagggcaccgcctccgacctcatcaaacgcgccatgatagacgtgtcccgctggctttcagagtgcgaagcctccccgtgggacgaactcttacaaagcaaactgattatgcaggtgcatgacgaactggtgctggaagtcgttgaaaccgaactggattttgtcaaagaaaaactgccgcagattatggcgaaagtggacggcggattattggatgtaccgctggtggctgaggttggcgtaggggagaattgggaagaggcacattgattgaaaggtgttatatgctatctttatttaaataaaatttaatttttggtatattttttctaaatgttcctatagtatagtggattaacaaaaatcaggacaaggcgacgaagccgcagacagtacaaatagtacggaaccgattcacttggtgcttcagcaccttagagaatcgttctctttgagctaaggcgagacaacgctgtactggtttttgttaatccgctatattccgccatctctaagatttacagcgatacacgggtgatttaaggaatgcccgaaccgtcattcccgcaacttttcgtcattcccacgaaagtgggaatctagaaataaaaagcagcaggaatttatcggaaataactgaaaccgaacagactagattcccacctgcgtgggaatgacaattcgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaattcataagtttcccgaaattccaacataaccgaaacctgacaataaccgtagcaactgaaccgtcattcccgcgcaggcgggaatctagaccttagaacaacagcaatattcaaagattatctgaaagtccgagattctagattcccgctttcgcgggaatgacgaaaagcaagccgtaggtcggatacttgtatccgacaaaagcctgccatctcaaatagccgtcggattcgagaatccgacctgccaaaccgggcgcggacgctccggccggcagttagtacgcaaatcgaacagaacatcacaaaaaagcccgattcggattttccaatcgggcttttttgcgcccgttttgtcatcccgtgaaatatccgcatgacaaaaatatagtgaattaacaaaaatcaggacaaggcgacgaagccgcagacagtacagatagtacggtaaggcgaggcaacgctgtactggtttaaatttaattcactataatgcaaaatcatgacaaaaccggcgcgaggttacacaaacggatgaaatcaaccgatattcaaacacagtcatttttagcgcattttcagcgtatcgttaatgcggaaaatttcgtgaacaggttttttgcacaggcctccgcctcgtttcgcgggatgggaaaccgtattagaaaacggacgcacgcaacataaaccccgaaagtgatgataagatgatgatttaacgtactgctttaattatttaaggaattatcgtgtttcccgacaaatacaagttgagtttgaaagaaaatatttttttggcaaagaaagtattggttgcccaaattcacaacctcagtcgttttgagaattgtcagacgaccttgttgcagaccgaacaaattatccatggcaaaaatgtagcctccgcgtcactggaagacatccaaaccatcttgaacctgaaacgtgcctatcaatatgtgatttcgcatatttcaaacggcgaaccggtcgatatttcactccttaaaaaaatcaacaacattgttgccaaggacgattctttggcacccggtgatttccgtaccggttcggtcggcgtaacgctattggacggttcccgtcatgccccgaatccagtgaaggaaattgaagtggcccgcgtgttacaaaatatcggactgcaaagcggttcgacgacggaggcagccgtccgttttatgctttattgtatgcggcagcaggttttttgggacggcaacaaacgaacggcaaccttatttgccaacggtctgatgatggcggggggctgcggcatcttggaaatctccgaaatgcagatgccgcaattcaatgaaaaactgtccgcattctatcgctccggcgacgataccgatatttccaagtttgtgtatcaaaattgtatatcgggcatagactgagacctttgcaaaattccccaaaaccccttaaattcccaccaagacatttaggggattttccatgagcaccttcttccagcaaaccgcccaagccatgattgccagacacatcgaccgtttcccgctattgaagttggaccaggtgattgattggcagccgatcgagcagtacctgaaccgtcaaaaaacccgttaccttagagaccaccgcggccgtcccgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggctatagaagtcgatgaggaaggacaaatcaacggccaaaccacaccgagtaaggacagcgatgcccgttggataaagaaaaacggcctctacaaactcggttacaaacaacatacccgtaccgatgcggaaggctatatcgagaaactgcacattacccccgccaatgcccatgagtgcaaacacctgccgcctttgttggaaggactgcccaaaggtcgaccgtctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttgtcgaagacccgttatagtggattaaatttaaatcaggacaaggcgacgaagccgcagacagtacaaatagtacggcaaggcgaggcaacgccgtactggtttaaatttaatccactatatgtggtcgaacagagcttcggtacgctgcaccgtaaattccgctacgctcgggcagcctatttcggactgattaaagtgagtgcgcaaagccatctgaaggcgatgtgtttgaaccttttgaaagcggccaacaggctaagtgcgcccgctgccgcctaaaaagcagcccggatgcctgattatcgggtgtccgtggaggattaagggggtatttgggtagaattaggaggtatttggggcgaaaatagacgaaaacctgtgtttgggtttcggctgtcgggagggaaaggaattttgcaaaggtctcagactatttcggcacggacgaagatatagatttccccgacccaccaaacatgggctaaaaatcaatttgacggttatcagacaatggagcaggcacaaggcggcggcagaaaaagggtttgacagcgcacggtggcatcgtcagacccctttcggcatatccggcggttaccagcggtagcctaatttgatgcccgcgctgtgttgcgcttccagttgcgggcctttggcggcggcagcgtggagggacagcgtgaaacctttgatttcggcgtttacgccccattccgcactgcgggttttgccgaaatcctgagccaatacggcggtattgacgcgtgttcggactttgcccgaagcggcatcggtataggacaggctcaaataaggcgtgatggaaatgtgttgcgccggtttgaatgaataatctgccttaatgcccgcgcggtagcggttgaatgcaaggccgggggtggcgatattgacgttttcgtagcggtaatccgctttttggacgaaatagcgcgttgcgccgatgtgcggttcgatgccgaatccgccgaaaccggcgcggtatcgtgcctgaatgccgtaatgcagcacgcggcggcggattttgcctccgatgccgtctgaaaggctgccgctgctaaaacccgcgcccgcgctgatgccgatgtagaacctgtcgatgccgtattgcccgaaaacggcgccgtgggcaagccgtgccgagttgccgatgccgtcgtcgaaggtgttttcggtccggttgtgcgaaaacaggatgccgacgcgcccgctgccgaggtttttctgcataccgatttggcgcaggtcggtttgttggcggtaggcgcggaaatcttgcgaacggtagtgtttggtgtcccggatgccgcttgtccaaacggcgttgcggcggtcttcggcaaatacgcggtctaattcgtcctgtacggcgaaaacgctgttgagcgtggcggaaaattcactcaaaccgctattggcataacggctgatcaggtcgcgctgcggttggggctgcggttggggttgcagttgcggcaaatcccggcgggcgcggcgggcgcgggggaaggcggtggtagccggccgggtttccgcttcgcgctgtttcgccaaggcggtgtctttatccgcctgcacccgttttttctcttcctccgcctgcataatgccgacattttccccgcctgcctgccgggccggttcggcaacgctttctgtcttttcgacggcatcgcgcccggccgcaatcagcgcgtcaaggctttgcgcgttgtctttttccgcctgttttttggcttctgccttgccgagtttgtcggaaagctcttgttctttgaccggattatgcaggcggaactcgccgtctttgcggatgagttggtaacgccacgcgccggcatcgacgtgttcgttttgcagggtgaaattaaggttttcggacagcggtttgttgtcttttccttccactaccgtcaattgttcgaggcttgcaggttcgttgccggtattgttgaccgccaaggtgtaagtgccttcggaactttccgccagcttcaatttgtcgctgcggtagccgaagagttccgacataaagcggaatgttccctgaccgttcaatttgccgtttaccgtcagcgtgttgaaacgggattctaccgaagttggcggtgtaacggataatagggaacggcgcgaacggcgcgaacggcggcgcggcgcatctgtcgcactgccggtttgcgcccctgccgcatcgtggcgataggcggaattgagtgtaatggtggcgttgtcaaggtttaaattgcctaattccgtgcctgacggcagcgtccattcgctgtcttttaagtgtaatgccgtatccttgccgccgctgatttgtccggtaaagcggctgctttcaaaatggaatactgccttatcggctagggagacattaccgttgagtgcggaatggcttacgtttgccttagcgttgccggaaagcgtcagactgccgttttgtacggcgtggtcgcttagattaaatgaagcattgcccgaagccgatgtgttgccgtttaatgtggcttgattaaatgttgcttgggcattgcccacgaggctaaggttgccgttttgggtggcgttgtggctgactgtataacgtgtatcgccatttgcactaagattgccgttgagtgtggcaagccctgtgagatttaaatgagcgtgatcggcaagatcgacattgccgctgatgtcggtcttagtcaatgaagcaatcactttatcgtcggtaatggttttttcgacacaatttgtcagacccgtccagtccgaacgtgtacagattgtgtggctttgatgcggtgcgacaccaaaaactgcttgggcgtgattgctcaaatgccaatcgcctttcactttggcaacattgcgggaaaccaccgcctgtccgcctttaatttggaagttttccgctttaaatgtgcggttgatccagtcgttgtcccacacgatttccccgcgaggaatgccctctttttgcgaccaatggtcgtttaaatgattgtaggcgtgcggtgttggtctgccgctgaaaaacagtttgccgtttgtttgcgtgatgttgccgtttaaatttgttccgccggaaagcagcagggtgcggtcttctgcggcgggctggtaaacaaggttgagccgcccgttcgttttggtcgtatctttctcgccaaaccaaccgttgtaggcaatttcttttttgctatccaagctgttgttattgccggttgtagcaatatctttattgcctgtaatggtaacggtggattctttgtcttgattgtggttgacaatcatcgccccttcatcggtattttgaatacggtggaacgaaagcgaatgcccgtttaaatccaaacgtccgccgcgaaagccgaaatagagtttgtcggggttgaactgattatcggcattcagttgcaccgtacccctgccgctgaccaagccgatttcactaaaggcttgttttttgcctttatcgtctgcctgctgatccaaaatgactgtaccgtcgcccacgctgatcgagccttggttttcccctttggcttgaacgtgcagcgtgcctttgccgattttggacaggcggtcgtttgccacgccgtttactttccaagtaacggtactgtcttcactgatatgaacgcccgcgccttgccaagtttcgttattttcaggcgagaccgtaaaatctccttggaaatataatcctccagcaccttgattgatgttgctggtaagtatcaattcgccttttccttcgtcaataaaggaaatattttctccattattcagtctgggtcgataactgttgacaccacctgcagcatgataaacaggttctcttgctgtctcggataaagaaacattaaacaattgaacggttcgtgtttttaatctattaggcagagaattgtgttcatgtttggcattgatttttcctgtgccattattatcgtcgttaaaagagtatttcccattttgacgtggttcgtagaatactgaatgggtatctccagcaaagatttcatcatagaaccaatctttacgaaccagctggaagccattgctttttcctatataggggttgcccgtttgcaataccccattaattaaccacttttgcttttgggcatcatagataaacattggtgagccactgtcgccaaatgagcctcctgttggtaaaaaaccatatgggctatgtttaattttttcactacctaagttgactgtgccaccacctgatccattttgtgcaaaggtattgccaccaacgagccaagaatacgcacttgcaatatgatatgaactttcgcggttattgggctcatcttcatcagatcgccaatattgcctgcctgccccaatacgaacacggtcagggtaattattttgatcgatatatttccgcccatccatataactggtcatttcaacaggttctgcatctgtgacaaatttatgcaaacgcggcatatgataatcgccgccataaggatggcctttagtccctgctttataattattccgtttcacaattttataagtaaaacgatgttgatcgggatttcttccttccgcaccaaaatcaacgttgttatagccgccgttatgtgccacgctcacaatatattgatcgcccaccaatgccgccacgccgttacgcgacaccacagaaaaatcaatcatcggggcttttgtcattgatttgccgaccaactccccttttttgttgtaaacctcaatatctttcgccccgactgcaaacttgcctttattttcggcaaagtcgcgatagtattggtagttgatgccgaaataagtgtgtcccgcccaggcttggggaagaatgccgaacgacaggcatatggctaagtaagcaggcgagaagcggatgcggccggttttcggggctttgcggtgtgtttcggttgtccgtttgtcggttgttttcattatttttccttatctgacgggattcgggtttgtttgggagggcgcggcttccgcttccgggcggcgcgcgggatgtgcctatatgtgcggttcggcgttcgggcggatatgaagcacgccctaggatttgtcattaatttttgccttggtctcggcttcttccaatcacgaaagcacccgccaaggcaaacactgtgccgccggcaagggaggcggcggttgcggggtagccgctccatacgaggaagacggcaaaaagcagtatcaggatggcgctgatgaagccgtacagttgcccgcgcctgttgaaggtttggtcttgccgtatggtttcgtgccggacggcttgttctttttccgccattgccataatgcggtctgccccgttgctgataatgtcgttgtattgcgccaagtcggacggcggcggcaacggtcccgaatggaaacaccgggctatcattatttgcacgtactcgtcggacaggatttgctcgacaagctccggggatttgacgacggtttcgacagcctgccgcgccttgtcctgtgcgttttcggtcattttcgcgctttctctatggcgcgttgaaaatcgccgccgatgtttttgagatcgtcggcgggattggggcggatggcggtttttgcgggatggaacagacccagcagcgagcctataccgagcaggagggcgtatgtgtttcgttttttcatatggttatatattaggtcaggcggacggatttatcaagcatttttgcggttttataccgtctgaaagccaaaccgtcggacttcagacggcatttgctataatcgcggctgttttgaattttcgggggttttatgtcggataacgttccaacgattgcggcagtcgctaccgcaccagggcgcggcggcgtgggcgtgatacgcatatcggggaaaaacctgctgccgatggcgcaggctttgtgcgggaaaacgcccaagccgcgtaccgcaacctatgctgattttacggacacggacggacaggcaatcgacagcgggcttttgctgttttttgccgcaccggcaagttttacgggtgaagatgtcatcgagcttcagggacacggcgggccggtggtgatggatatgctgctgaaccgctgtttggaattgggcgcgcgccttgccgaaccgggcgagtttacgaagcgtgcgtttttgaacgacaaactggacttggcacaggcggaaggcgtggcggatttgattgacgcatccagccgttcggcggcgcgtctggctttgcgctcgctcaagggcgatttttcgcggcggatacacggtctggtcgaagacttgattaccttgcggatgctggtcgaagcgacgttagattttcccgaggaagacattgattttctcgaagcggcagacgcacgcggcaaactggacggcttgcgccgcgccgtggatgatgtgcttgccaacgcgcagcagggcgcgattttgcgcgaaggtctgaatgtcgtattggtcggcgcgccgaatgtgggcaagtccagcctgctgaacgcgttggcgggcgacgaagtggcgattgttaccgatattgccggaacgacgcgcgacgcggtcagggaacgtatcctgattgacggcgtgccggtgcatattgtcgatacggcaggtttgcgcgagacggacgacgtggtcgagcgtatcggcatcgaacgcagccgcaaagccgtatccgaagccgatgtcgcgctggtgttggtcgatccgcgcgagggtttgaatgaaaagacacgggcgattttggacgcgttgccgccggagttgaaacgcatcgaaatccacagcaaatccgatttgcacgcacacgcggcaggcgggttcggtacgggcgcggaaaccgtcatcgcgttgtcggcgaaaaccggcgacggcttggacgcgctgaaacggacgttgttgcgcgaggccggttggcagggcgaaagcgaagggttgtttttggcgcggacgcggcacgtcaacgcactcaaagcagcgcaggaagaattgtcgctggcggcattgtgcggcaaccatcaaatcgagctgtttgccgaacacttgcgcttggcgcaggtcgcatgcggcgaaatcacgggcgagtttacggcggacgacctgctcggcgtgattttttcgaggttttgtatcggaaaataaacggatcgaaagcatcgtggtggtgtccggctgaacattccgttatcccataaaaacgggaatccgatccgtttggttttatagtggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactatagtttttttgaatttcgggcaacgcttgaatcttcattccgcgcaggcggaaattatcggtgcggtacggcaacttttttcgatatgaaaagaccgtcattcctgtaaaaacaaaaaatcaaaaacagaaaattgaaattcgtcattcccgcgcaggcgggaatccaggacgtaaaatctatagtggattaacaaaaaccagtacagcgttgccttgacttagctcgaagagaacgattctctaaggtgctgaagcaccgagtgagtcggttccgtactatccgtactgtctgcggcttcgtcgccttgtcctgatttttgttaatccactataaagaaaccgtttttctcgataagtttccgtgccgacagacctggattcccactttcgtgggaatgacggtggaaaagttgccgtgatttcggataaattttcgtaacgcataatttccgttttacccgataaatgcccgcaatctcaaatcccgtcattccccaaaaacaaaaaatcaaaaacagaaatatcgtcattcccgcgcaggcgggaatctagaccttagaacaacagcaatattcaaagattatctgaaagtccgggattctagattcccactttcgtgggaatgacgaattttaggtttctgtttttggttttctgtccttgcgggaatgatgaaattttaagttttaggaatttatcggaaaaaacagaaaccgctccgccgtcattcccgcacaggcttcgtcattcccgcgcaggcttcgtcattcccgcatttgttaatccactatattcccgccgtttttttacatttccgacaaaacctgtcaacaaaaaacaacacttcgcaaataaaaacgataatcagctttgcaaaaatccccccccccctgttaatataaataaaaataattattaattatttttcttatcctgccaaatcttaacggtttggatttacttcccttcatactcaagaggacgattgaatgaataccccattgttccgtctcagcctgctctcgcttaccctggcggcaggttttgcccatgcggcagaaaataatgccaaggtcgtactggataccgttaccgtaaaaggcgaccgccaaggcagcaaaatccgtaccaacatcgttacgctgcaacaaaaagacgaaagcaccgcaaccgatatgcgcgaactcttaaaagaagagccctccatcgatttcggcggcggcaacggcacgtcccaattcctgacgctgcgcggcatgggtcaaaactctgtcgacatcaaggtggacaacgcctattccgacagccaaatcctttaccaccaaggcagatttattgtcgatcccgctttggttaaagtcgtttccgtacaaaaaggcgcgggttccgcctctgccggtatcggcgcgaccaacggcgcgatcatcaccaaaaccgtcgatgcccaagacctgctcaaaggcttggataaaaactggggcgtgcgcctcaacagcggctttgccagcaacgaaggcgtaagctacggcgcaagcgtattcgggaaagagggcaacttcgacggcttgttctcttacaaccgcaacaatgaaaaagattacgaagcaggtaaaggcttccgtaataatttcaacggcggcaaaaccgtaccgtacagcgcgctggacaaacgcagctacctcgccaaaatcggaacaagcttcggcgacggcgaccaccgcatcgtattgagccatatgaaagaccagcaccggggcatccgtaccgtccgtgaagaatttaccgtcggcggcgataaagagcgaataagtatggaacgccaagcccctgcttaccgcgaaaccacacaatccaacaccaatttggcgtacacgggtaaaaacctgggctttgtcgaaaaactggatgccaacgcctatgtgttggaaaaagaacgctattccgccgatgacagcggcaccggttacgcaggcaatgtaaaaggccccaaccatacccaaatcaccactcggggtatgaacttcaacttcgacagccgccttgccgaacaaaccctgctgaaatacggtatcaactaccgccatcaggaaatcaaaccgcaagcgtttttgaattcacaatttaaaattgaagataaagaaaaagcaactgatgaagagaaaaataagaaccgtgaaaatgaaaaaattgccaaagcctaccgtctgaccaacccgaccaaaaccgataccggcgcgtatatcgaagccattcacgagattgacggctttaccctgaccggcgggctgcgttacgaccgcttcaaggtgaaaacccacgacggcaaaaccgtttcaagcaacaaccttaacccgagtttcggcgtgatttggcagccgcacgaacactggagcttcagcgcgagccacaactacgccagccgcagcccgcgcctgtatgacgcgctgcaaacccacggcaaacgcggcatcatctcgattgccgacggcacgaaagccgaacgcgcgcgcaataccgaaatcggcttcaactacaacgacggcacgtttgccgcaaacggcagctacttctggcagaccatcaaagacgcgcttgccaatccgcaaaaccgccacgactctgtcgccgtccgtgaagccgtcaatgccggttacatcaaaaaccacggttacgaattgggcgcgtcctaccgcaccggcggcctgactgccaaagtcggcgtaagccacagcaaaccgcgcttttacgatacgcacaaagacaagctgttgagcgcgaatcctgaatttggcgcacaagtcggccgcacttggacggcttcccttgcctaccgcttccaaaacccgaatctggaaatcggctggcgcggccgttatgttcaaaaagccgtgggttcgatattggtggcaggtcaaaaagaccgcaacggcaaattggaaaacgttgtacgcaaaggtttcggtgtgaacgatgtcttcgccaactggaaaccgctgggcaaagacacgctcaatgttaatctttcggttaacaacgtgttcaacacgttctactatccgcacagccaacgatggaccaataccctgccgggcgtgggacgtgatgtacgcttgggcgtgaactacaagttctaaaacgcacatcccgaaaaaatgccgtctgaaagcctttcagacggcatctgttctgataatttgatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataaagaccgtcgggcatctgcagccgtcattcccgcgcaggcgggaatctagaccttagaacaacagcaatattcaaagattatctgaaagtccgagattctagattcccgctttcgcgggaatgacgaaaggttgcgggaatgacgaaaagtggtgggaatgacgaaaagtgatgggaatgacgaaaagtgatgggaatgacggttcgggcattccttaaattacccgtgtatcgctgtaaatcttagagatggcggaatatagcggattaacaaaaaccagtacggcgttgcctcgccttagctcaaagagaacgattctctaaggtgctgaagcaccaagtgaatcagttccgtactatttgtactgtctgcggcttcgtcgccttgtcctgatttttgttaatccactatagattatcatttatcctttctaaagccgttccggtttgtccgaccggcggctttgccccaatatccccattttggagacacctatgttacgtttgactgctttagccgtatgcaccgccctcgctttgggcgcgtgttcgccgcaaaattccgactctgccccacaagccaaagaacaggcggtttccgccgcacaaaccgaaggcgcgtccgttaccgtcaaaaccgcgcgcggcgacgttcaaataccgcaaaaccccgaacgcatcgccgtttacgatttgggtatgctcgacaccttgagcaaactgggcgtgaaaaccggtttgtccgtcgataaaaaccgcctgccgtatttagaggaatatttcaaaacgacaaaacctgccggcactttgttcgagccggattacgaaacgctcaacgcttacaaaccgcagctcatcatcatcggcagccgcgccgccaaggcgtttgacaaattgaacgaaatcgcgccgaccatcgaaatgaccgccgataccgccaacctcaaagaaagtgccaaagagcgcatcgacgcgctggcgcaaatcttcggcaaacaggcggaagccgacaagctgaaggcggaaatcgacgcgtcttttgaagccgcgaaaactgccgcacaaggtaagggcaaaggtttggtgattttggtcaacggcggcaagatgtcggctttcggcccgtcttcacgcttgggcggctggctgcacaaagacatcggcgttcccgctgtcgatgaatcaattaaagaaggcagccacggtcagcctatcagctttgaatacctgaaagagaaaaatcccgactggctgtttgtccttgaccgaagcgcggccatcggcgaagagggtcaggcggcgaaagacgtgttggataatccgctggttgccgaaacaaccgcttggaaaaaaggacaggtcgtgtacctcgttcctgaaacttatttggcagccggtggcgcgcaagagctgctgaatgcaagcaaacaggttgccgacgcttttaacgcggcaaaataatgaaacggcggcattcgatgccgtctgaaacacggatgcaaaccgcctcctgtgtttcagacggcattgcccgatacggaggcttcaaacaaggctttccgctccgacggttcggactgccttgtttgaatcttctacgccttaacgcttttcccttctgtttatgactgccaaacctttttccctcaacctgaccaacctgctgctgctggcggtgttgtttgccgtcagcctgtcggtgggcgttgccgatttccgctggtctgatgtgttttcactgtccgacagccagcaggtcatgttcatcagccgcctgccgcgcacgtttgcgattgtgctgacgggcgcgtcgatggcggtggccggcatgattatgcagattttgatgcgcaaccgttttgtcgaaccgtcgatggtgggcgcaagccaaagcgcggctttaggtttgctgctgatgaccctgctgctgccggccgcgccgctgccggcgaaaatgtcggttgccgccgttgccgcgctgatcgggatgttggtctttatgctgctgatccgccgcctgccgccgaccgcgcaactgatggtgcctttggtcgggattattttcggcggtgtgattgaggcggtagccacctttatcgcgtatgaaaacgaaatgctgcaaatgctcggcgtgtggcagcagggcgatttttcgagcgtgctgctggggcggtacgagctgctttggattacgggcggtttggcggtgtttgcctatctgattgccgaccggctgacgattttggggctgggcgaaacggtaagcgtgaatttgggtttgaaccggacggcggtgttgtggtcgggtttgattattgtggctttgattacgtcgctggttatcgttacggtcggcaatattccgtttatcgggctggtcgtgccgaacatcatcagccgcctgatgggcgacaggttgcgccaaagcctgcctgcggtggccttgctgggcgcatctttggtgttgctgtgcgacattatcggacgcgtgattgtgtttccgtttgaaattccggtctctacggtttttggtgtattgggtacggctttgtttttgtggcttttgttgaggaaacccgcctatgccgtctgaaaaaaatatcggttttatggcaggaagcagccgcccgttgtgggtcgcctttgcgctgttgctggtttcctgcgtcctgtttatgacgctcaacgtcaaaggcgattgggattttgttttgcaactgcggctgaccaaacttgccgcgctgctgatggtcgcctatgcggtcggcgtgtccacgcaactcttccaaacgctgaccaataatccgattctgaccccttcaattttgggtttcgattcgctgtatgtgtttttgcagaccttgctggtgtttacgttcggcggcgtgggctatgcttccctgccgttgacgggcaaattcggctttgaactggtcgtcatgatgggcggctcgctgctgctgttctacacgctcatcaaacagggcggacgcgatttgtcgcgcatgattttaatcggcgtgattttcgggattttgttccgcagcctgtcgtcgctgctttcgcgcatgatcgatcccgaagaatttaccgccgcgcaggcgaatatgtttgccggattcaataccgtccacagcgagcttttgggcataggcgcgctgattctgctcgtcagcgcggcggtcgtttggcgcgaacgctaccgcttggacgtttaccttttggggcgtgaccaagccgtcaatttgggcatcagctacacgcgcaacaccttatggatactgctttggattgccgcattggtggcgacggcgaccgccgtggtcggccccgtaagctttttcgggcttctcgccgcctcgcttgccaaccacttttccccgtcggtcaaacattccgtccgcctgccgatgacggtttgtatcggcggcatcctcttggtcggcggacagaccgtgttcgaacacctgctcggtatgcaggcagtgttgagcgtagtagtagaatttgccggcggactcgttttcctctatctcgttttaaaacacaaaaaatgacggatgccgtctgaacggccgccgccccgaaaggacaaaccatatgacacaagaacatttcccatcattcttcaaccaagccccgaccattaccgtccaagacgcattggccgaattcctcggcgcggccgaaaacggcatcctcacttaccgctacgccgatgccgtgcgcctgtgcggacattcctgcccgaccgtcgcgggcgcgtacctgatggttatcaaaggtctgaaagcactttacggcgaagagctgcccgaacgcggcggcatcgaagcctttatgcagggcgcgcgcgacgaaggcacggtcggcgtaaccgcgtccgtcgtccaactcctcaccggcgcagcccccgaaaccggctttggcggcatcggaatgcagggacgctttgcccgccgccacctcttatcctttggtgtaggcgaaatcaacggcacactgaccctgcgccgcaaagacaacggcaaaaccgtcgccgtcggcctcaacgccgccctgcaacccttcgcacccgaaatgcgcgacatcatgcccaaagccgtcagcggcagcgcaagcgcagaagaactcgaacgcttcggacaactctggcaggcacgcgttaaagcatttttaaccgaatcggcggacgacccgcagttcgtcatcgtccgcgaagtgtgagcgttcagacggcattccgaatttcaaatgccgtctgaaccccgccaaacaacaacaaacctacgcccgacaagcatccgccatgattaccatccgcaacgtcagctaccgcatcggcacacgccccatcctcgacaacgtcagcctcgacatccccgaaggcggcattaccgccctcgtcggccccaacggtgcgggcaaatccaccctgttttcctttatggcgcggctgcgaccgcttgaaagcggcagcatcgcctaccgaggcaaaaatcttgccgatacccccaccgccgaactcgccaaaaccctgtccatcctcacccaagaaaacagcatcatgagccgcatcaccgtgcgcgacctgctgatgttcggccgttacccctaccatcaaggcagaccgactgccgaatgccgccgtatcgttaacggtgcaatcgaagaattccacctgcaagacctctccgaccgctacctgaccgagctttccggcggccaacgccaacgcgccatgattgcgatggtgttctgccaaagcaccgactacgtccttttggacgaaccgctgaacaacctcgatatgtatcacgcccgctcgctcatgcaaatcctgcgccggctgaccgacgaacacaagcgcaccaccgtcgtcgtattgcacgacatcaaccaggcagcagcctacgccgaccacgtcgtcgccatgaaaaacggccaagtcgccatgcagggcaaacccaacgatattttcaccgccgcaaacatcaaaaccctattcgatatggacgtcgacgtcctcgattacgaaggcaaaaaattggttatccaccatatctaaatccgacaaaaaggccgtctgaacattcagacggcaacccatatcctgacaaaattaagacacgacaccggcagaattgacatcagcataatatgcacatattaacagatattaatgccgaactacctaactgcaagaattaaataaataaataaataaataaataaataaataaattgcgacaatgtattgtatatatgcctcctttcatatatactttaatatgtaaacaaacttggtggggataaaatacttacaaaagatttccgccccattttttatccactcacaaaggtaatgagcatgaaacactttccatccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaagcagcatctcccgataaagaaaccgcagccctgcaaggctgcggtttttattttctatccggccgtcagactgccgcgtccgaacgttcgcccgtgcggatacggattgcctcctcaaccggcagcacaaaaatcttgccgtcgccgatttttcccgaacgcgccacctcgaaatcacgtcaatcgcgcgttccacagcatcatccgccaacaccagctcgattttgattttgggcaggaaatcgacggcgtattccgcgccgcgatagatttccgtatgccccttctgcctgccgaaccctttgacctcgctgacggtcatgcccgtaatgccgatttccgtcaacgcctcgcgcacgtcgtcgagtttgaacggtttgacaatcgcctcgatttttttcataaaatttcctttgaacaaacaatacaaacacatccgaaaaacgggaacctcccgtcagattgtcaacattttaagccaaaatacccaagcaatacagccccgttgcgcgtataatgacagattttccaaccgcatttgagagccgaatccatgtctgtcgttttgcccttgcgcggcgttaccgccctttccgatttccgtgttgaaaaactcttgcaaaaagccgccgcactcggtctgcccgaagtcaaattaagcagcgaattttggtatttcgtcggcagcgagaaagcacttgatgccgcgactgtcgaaaaactgcaagccttgttggcggcgcaaagcgttgaacaaacgccaaaagcgcgcgagggcttgcatttgtttttggtcacgccccgtttgggtacgatttcgccgtgggcttccaaggcgaccaatatcgcggaaaactgcggtttggcaggcatcgaacgcatcgagcgcggtatggcggtgtggctggaaggtcgtctgaacgatgaacagaaacagcaatgggcggctttgctgcacgaccgcatgaccgaaagcgtgctgcccgattttcagacggcctccaaattattccaccatctcgaatccgaaactttctccggcgtcgatgttttgggcggcggtaaagaagctttggtcaaagccaataccgaaatgggcttggcactttccgccgacgaaatcgattatctggtcgaaaactatcaggctttgcagcgcaatccgtccgatgttgaattgatgatgttcgcgcaggcaaacagcgaacactgccgccacaaaatcttcaacgccgatttcatcctcaacggcgaaaagcagcccaaatccctcttcggtatgatacgcgacacacacaacgcgcatcccgaaggcacggtcgttgcctataaagacaattcgtccgtaatcgaaggcgcgaaaatcgagcgtttctatccgaatgcggcggaaaaccaaggctaccgtttccacgaggaagacacgcatatcatcatgaaagtggaaacgcacaaccacccgaccgccatcgcgccgtttgcgggtgcggcgacgggcgcgggcggcgaaatccgcgacgaaggcgcgacgggcaaaggttcgcgtccgaaagcgggcctgaccggctttaccgtgtccaacctcaatattcccgacctcaaacagccgtgggaacaagactacggcaagccggaacatatttcctcgccgctggacatcatgattgaaggcccgatcggcggcgcggcgttcaacaacgaattcggccgccccaacctcttgggctacttccgcacttttgaagaaaaatttgacggtcaggttcgcggctatcacaaaccgattatgattgccggcggcttgggcagcattcaggcgcagcagacgcataaagacgaaatccccgaaggcgcattgctgatccaactgggcggcccgggtatgcttatcggcttgggcggcggcgcggcttcttcgatggataccggcacaaacgacgcgtctttggacttcaactccgtgcaacgcggcaaccccgaaatcgaacgccgcgcgcaggaagtcatcgaccgctgctggcagctcggcggcaaaaacccgattatctccatccacgacgtaggcgcgggcggcctgtccaacgccttccccgaactggtcaacgatgccagacgcggcgcagtattcaagctgcgcgaagtgccgcttgaagaacacggcctcaacccgctgcaaatctggtgcaacgaatcgcaagagcgttatgtgttgtcgattttggaaaaagatttggatgctttccgcgccatctgcgaacgcgaacgctgcccgtttgccgtagtcggcacggcgactgacgacggtcatttgaaagtacgcgacgatttgttcgccaacaatcccgtcgatttgccgttgaacgtcttgctcggcaaactgcccaaaaccacgcgcaccgacaaaacggttgcaccgtccaaaaaaccgtttcacgcgggcgatatcgacattaccgaagccgcctaccgcgttttgcgcctgcctgccgtagccgccaaaaacttcctgattaccatcggcgaccgcagcgtcggcggtttgacgcaccgcgaccaaatggtcggcaaatatcaaactccagtagccgactgcgccgttaccatgatgggcttcaacacctatcgcggtgaagcgatgtctatgggcgaaaaaccgaccgtcgccctgtttgatgcgcctgcttcgggcagaatgtgcgtcggcgaagccatcaccaacatcgcggcggtcaacatcggagacatcggcaacatcaaactctccgccaactggatggcggcgtgcggcaacgaaggcgaagacgaaaaactctaccgcactgtcgaagccgtttccaaagcctgtcaggcattggatttgagcatccccgtgggcaaagacagcctgtcgatgaaaaccgtttggcaggacggcgaggagaaaaaatccgtggtttcaccgttgagcctgattatctcagcgttcgcgcctgtgaaagacgtacgcaagactgttacgcctgagttgaaaaacgtcgaagacagcgtattgttgtttgtcgatttgggcttcggcaaagcgcgtatgggcggttcggcgtttggtcaggtgtacaacaatatgagcggcgacgcgcccgatttggacgatacaggtcgtctgaaagccttttacagtgtgattcagcagcttgttgccgaaaacaaactcttggcgtatcacgaccgcagcgacggcggcttgtttgccgttttggtagaaatggcgtttgcggggcggtgcggcttggatatagatttaaatttattgcttgcacaaacatttattaccaaccataccgctctgtctcaatcattgcggactgaagaggtaaaagcgttggctgaatggcaagaaaccattgcccgcacattatttaatgaagagttgggtgctgttatccaagttagaaaacaagatgttgccgatattatcaatttattctatcaacaacagctgcatcataatgtctttgaaatcggtacgttaactgatgagaacacgttaatcatccgcgacgggcaaacgcaccttatttctgacaacctaatcaaactgcaacaaacctggcaagaaaccagccatcaaatccaacgcctgcgcgacaaccctgcctgcgccgacagcgagttcgcactgattggcgacaacgaacgcagcgcattgtttgccgacgtgaagttcgacgtgaacgaagacatcgccgcgccgtttatcaacagcggcgcgaaacccaaaatcgccatcctgcgcgaacagggcgtaaacgggcaaatcgaaatggccgccgcctttacccgcgccggattcgatgcttacgacgtgcatatgtccgacctgatggcaggccgcatccacctcgccgacttcaaaatgctggcggcgtgcggcggcttcagctacggcgacgtactcggcgcgggcgaaggctgggcgaaatcgattctgttccaccctgctctgcgcgaccagtttgccgccttcttcgccgacccggacacgctgacattgggcgtgtgcaacggctgccaaatggtcagcaaccttgccgaaatcatccccggcacggcaggctggccgaagttcaaacgcaacctgagcgaacagtttgaagcacgcctgagcatggttcacgttccgaaatcagcgtcgctgattctgaacgaaatgcaaggctccagcctgcctgtcgtggtcagccacggcgaaggccgcgccgacttcgcgcttcacggcggcaatatttccgccgatttgggcattgcgctgcaatacatcgacggacaaaaccaagtgacccaaacttatccgctcaaccccaacggctcgcctcaaggcatcgccggcgttactaacgccgacggccgcatcaccatcatgatgccccaccccgaacgcgtgtaccgtgccgcgcaaatgagctggaaaccggaaggctggacggaactgtccggctggtaccgcctctttgccggcgcacgtaaagccttgggctaaccgccctactcaaaccaatgccgtctgaagaatatttcagacggcgttccggcataccatcctttaaacggtatccgtccaccgaggaacactcatgaaaatcacccccgtcaaagccctaaccgacaactacatctggatgatacagcacggcaaccatgccgtctgcgtcgacccttccgaaccctcgcccgtcttggaattcctcgtccgcaaccgcctcatgcttgcccaaacatgggtaactcacccccatcccgaccacgagggcggtgcggcggcactctggcgcggctacatggaatcgcccgtttacggcgaatccgacatcgaagcagcaacccacaccgtaaccgccggcacccaattcaccttcggcgacggacaggttaccgtttgggcaacacccggccacacagaccgccacaccagctaccttctcgaaacttcagacggcatacacgtcttttgcggcgacacccttttttccgccggctgcggacgcgtgtttaccggcacaatcgaacagctttacgacagcttccaacgcttcaaccgcctgcctgaaaacaccctgttctatccggcgcacgaatacaccgccgccaacctgcgtttcgccgcccatatcgagccggacaacgccgacattcagacggcactgaaagcggcggcgcatacgcctaccctgcccgttaccctcgcgcacgaacgccgcgtcaatccgtttttgcgcgtcgacctgccgcacgtcagagaccgcgccgaggcattgagcgggaaaacgttaaacagcagcctcgatacctttgtcgcgctgcgtgaacttaaaaaccaataccggacgaaataaaacaacgggaaaacgcagccattcctaggatttttattaaaatcttaaataaaatcatacaatcatcgccaatagacgaaaggacaccgttgccttataatcaaacaaaaacaaaatatataatatagtggattgaatttaaatcaggacaaggcgacgaagccgcagatagtacggcaaggcgaggcaacgctgtactggtttttgttaatccactatattgttaatccactatataaatccagcacaaaacgggatcggtgattcttgtccgcaagaatcgttgattttctctattacacggataatcatcatgcgcttcacacacaccaccccattttgttccgtattgtccaccctcggtctttttgccgtttcccctgcttactcatccattgtccgcaacgatgtcgattaccaatattttcgcgactttgccgaaaataaaggcgcgttcaccgtaggtgcaagcaatatttccatccaagacaagcaaggcaaaatattaggcagggttctcaacggcatccccatgcccgacttccgcgtcagcaaccgccaaaccgccatcgccaccctggttcacccccaatacgtcaacagtgtcaaacacaacgtcggctacggttccatacaattcggcaacgacacccaaaatccagaagaacaagcctatacctaccgcctcgtatcacgcaacccgcacccggactacgactaccaccttccccgcctcaacaaactggttaccgaaatctcacctaccgcactcagcagcgtacccttgcttggaaacggccagccaaaggccaatgcctacctcgataccgaccgcttcccctactttgtacgactcggctcaggcacgcaacaagtccgcaaagcagacggcacgcgtacacgaaccgccccggcataccaatacctgaccggcggcacgccgctgaaagtattggggttccaaaaccacggcttactcgtcggcggcagcctgaccgaccaaccccttaacacctacgcaatcgccggagacagcggttcccccctgtttgccttcgacaagcatgaaaaccgctgggtgcttgcgggcgtactcagcacctacgccggcttcgataatttcttcaacaaatacatcgtcacgcaacccgaattcatccgttccaccatccgccaatacgaaacccggctggatgtcgggctgaccaccaacgaactcatatggcgcgacaacggtaatggcaacagcaccctgcaagggctcaacgaacgcatcaccctgcccattgcaaacccttcgcttgccccacaaaacgacagcaggcacatgccgtctgaagatgccggcaaaacgctcatcctatccagcaggttcgacaacaaaacactgatgctggcagacaatatcaaccaaggcgcaggcgcattgcagttcgacagcaacttcaccgtcgtcggtaaaaaccacacatggcaaggtgcaggcgttatcgtagccgacggcaaacgcgtcttctggcaagtcagcaaccccaaaggcgaccggctctccaaactgggcgcaggcacgcttatcgccaacggacaaggcatcaaccagggcgacatcagcatcggggaaggcactgtcgtactcgcccaaaaagctgcttcagacggcagcaaacaagcattcaaccaagtcggcatcaccagcggcaggggcacggccgtcctcgccgacagccagcaaatcaaacccgaaaacctctatttcggcttcaggggcggacggctcgacctcaacggcaacaaccttgcctttacccatatccgccatgcggacggcggcgcgcaaatcgtcaatcacaaccctgaccaagccgcgacactgacgctgaccggcaaccccgtcctcagtcccgagcatgtcgagtgggtgcaatggggcaaccgtccgcaaggcaacgcggcggtttacgaatacatcaacccgcaccgcaaccgtcggaccgactacttcatactcaaacccggcggcaacccgcgcgaatttttcccgttaaatatgaaaaactcaacaagctggcaatttatcggcaacaacaggcaacaggccgccgaacaagtcgcccaagccgaaaatgcccgccccgacctgattaccttcggcggatacttgggtgaaaacgcgcaaacgggcaaagccgcgccgagttacagcaaaaccaatgaagcagccatagaaaaaacccgccatatcgcaaatgccgccgtatacggccggcccgaataccgttacaacggcgcactcaacctgcactatcgtcccaaacgcaccgacagcacgctgttgctcaacggcggcatgaaccttaacggggaagtcttgattgagggcggcaatatgattgtgtcaggcaggcccgtaccccatgcctacgaccaccaggccaaacgcgaacccgttcttgaaaacgaatggaccgacggcagcttcaaggctgcacggttcaccctgcgaaaccatgcccgactgacggcagggcgcaataccgcgcatctggacggcgacataaccgcatacgatctgtccggcatcgacctcggctttacccaaggcaaaacaccggaatgctaccgctcctaccatagcggcagcacccactgcacacccaacgccgttttaaaagccgaaaactatcgtgcactacctgcaacgcaagtacgcggcgacattacccttaacgaccgttcagagctccgcctgggcaaagcacacctgtacggcagcatccgtgccggcaaagacaccgcagtccgcatggaagcagacagcaactggacactttcccagtccagccacaccggcgcactgacgcttgacggcgcacaaattaccctgaaccccgatttcgccaataatacacacaacaaccgcttcaacacactgaccgtcaacggcacacttgacgggttcggcacattccgattcctgaccggcatcgtccgaaaacaaaatgccccccccctcaaactggaaggggacagccgcggcgcattccaaatccacgtcaaaaacaccggacaagaacctcaaacaaccgaatcgcttgcacttgtgagcctcaatccgaaacacagccaccaagcccgattcaccctccaaaacggctatgccgatttgggtgcctaccgctacatcctccgcaaaaacaacaacggatacagcctgtacaacccgctcaaagaggccgaacttcaaattgaagccacgcgtgcggaacatgagcgcaaccaacaggcatacaaccaattacaggcaaccgacatcagcagacaggttcaacatgactctgacgcgaccaggcaggcactacaggcctggcagaacagtcaaaccgaacttgcccgcatcgacagccaagtccaatatctgtccgcccaattgaaacagacagacccgctgaccggcattctgacgcgtgcccaaaacctgtgtgccgcacaaggatacagtgccgatatctgccgtcaggttgccaaagccgccgacacgaacgacctgacactcttcgaaaccgaactggatacgtatatagaacgtgtagaaatggccgaatccgaacttgacaaagcacggcaaggcggcgatgcgcaagccgtcgaaacagcccggcacgcctacctgaacgcactcaaccgtctgtcccgacaaatccacagtttgaaaaccggcgttgccggcatccgtatgccgaacctggccgaactgatcagccggtcggccaacaccgccgtttccgaacaggccgcctacaataccggccggcaacaggcgggacgccgcatcgaccgccaccttaccgatccgcagcagcaaaacatctggctggaaaccggtacgcaacaaaccgactaccatagcggcacacaccgtccctaccaacaaactaccaactatgcacatatcggcatccaaaccggcatcaccgaccgtctcagtgtcggtacgattttaaccgatgagcgcacaaacaaccgttttgatgaaggcgtatccgcccgaaaccgcagcaacggcgcacatctgttcgtcaaaggggaaaacggcgcactctttgccgcggcagatttaggctacagcaacagccgtacccgatttaccgattatgacggggctgccgtccgccgccacgcatgggatgcaggcatcaacaccggcatcaaaatcgataccggcatcaacctcagaccctatgccggcatccgtataaaccgcagcaacggcaaccggtacgtactcgacggcgcagagataaacagcccggcgcaaatccaaaccacatggcatgccggcatccgtctcgataaaaccgtcgaactgggtcaagccaagctgacccccgccttcagcagcgattactaccatacccgccaaaacagcggttccgccctcagcgtcaacgaccgtaccttactgcagcaagccgcccacggcacactgcataccctgcaaatcgacgccggatacaaaggctggaacgccaaacttcatgccgcttacggcaaagacagcaacaccgcccgccacaaacaggcaggaatcaaaataggctacaactggtaacaagccgataaaaatgccgtctggaacccgcgtttcagacggcatttgcgttaaaaatagtaaaccgttccaaaagggagtagaatagtgccgtttccaaccctgcgcctgtaccgtcaggcttttattatggaccttcccagttcgtttttactgaacaccccatccgattcaaacccgcaataaccatcccgccggaatgcctccccgcacacggcgggcggagcatttatgagcatcgaaccaacccctccgaaccttgaaaacgacggtatcgaaaacgatgtagaacgcgtttccgccgatttcgaccgtgtccactccctctgcgaaatcctcgaacctgcttttgaacaaatcgaaaacggtacaccgctcgaagacgcgccgctgcgcgacaagctgaccgagctgaccgtcctcttgagcgagctgcaccctgccgacgtggcggcggtattggaatcgctaccgccgcgcgaacgcaatatcgtctggattctggtcaaaccggaagacgacggcgaagtattgctggaagtatccgacgcggtgcgcgaaacgctgatcgagtcgatggacaaagacgaattgttggcagcggtcgatgatttggacgcggacgaattggcggaactggcagacgatttgccgcaccaagtggtttacgaagcgctacaaacccgcgatgaggaagaacgcgcccaagtcaaagcggcaatgtcctacgaagacaaccaagtcggtgcgattatggacttcgagttggtcagcatccgcgccgatgtcgcctgtgaagtggtgctgcgctatctgcgccgcttcgacagcctgcccgaccataccgacaagatttttgtggtcgatgaaaacgacgtactgcagggcgtgctgcccatccgcaaacttttggtcgccgatcccgaagacttggtggaaaacgtgatggcgaaagatgtcgtgcgtttccgcgccgaagatgacgtggaagaagcggcgcaggcgtttgaacgctacgacttggttaccgcgcccgtcgtcgatgaaaacaaaaagctcatcggcaggattaccatcgacgagatggtggacgtgatccgcgaagaatcggaagcggatatgctgaatatggcgggtttgcaggaagaggaagacctgttcgcccccgtgtgggattcggtgaaaaaccgctggatgtggctcgccgtcaacctctgcaccgccttcctcgccagccgtgttatcggcgcgtttgaaggcagcatcgaaaaaatcgtcgcactcgccgcgctgatgcccatcgtcgccggcataggcggtaactcgggcaaccagacgattaccatgattgtccgcgcgatggcgatggggcagctgacggatatgcaggcggggcgtttgctgaaaaaagaagtcggtgtcgccttggtcaacggcatcatttggggaacggtcatgggcgcagtatcttggctgctttacggcagcctcggcatcgggctggttatgattgccgcgatgacgctcaacctcctgctggcggcaaccgtcggcgtattaattcccgtggtaatggaaaagttcggacgcgatcccgcactgggcagctcggtgctgattaccgccgttaccgactccggcggcttcctgattttcttggggctcgccaccctattcctgctttaaatgccgtctgaacccgcgcaaaaatgccgtctgaagcggaagctgcttcagacggcatttgactatttatccttgttgcacaagattattggacggtatgccggggcagccctttggcaacgccgaccacatcctccccgaacagcgcgttgacatcggtttcgtcaaacacatatttgctgtggcagaaatcgcaatcgacttcgatgctgccttgttccaccaccacgccgccgacttcttccccgcccagcatcaacagcatatcgctgactttgccgcgcgaacaggtgcatgaaaattcaaacgtttccggctcgaacacgcgcggcggcgtttcgtggaacaggcggtataaaacgtgttgcgcgtccagtcctgccagctcctccgccgtcagcgtgcgcgccagcgtactgacgtgttcccatgcctcttcatccaatacctcttcaggcagacgctgcaccagcagaccgcccgccgcttcgtcgcttgcagacaggacgatgtgcgtatcaagctgttcggaacgtttcatatagttcaccaacatttgcgcgataccgccgccttccaaaggcactacgccctgccagggttcgccgtctttgggctgcagcgtcagcacgaatacgccgccctcgcccaaaaggtcgccgaggctttcgtcatcggctatttctgcggtttcgtcccaacgcgcggttgcacggacggtacggtcggaagccgcttccgcaaccagcattttcagccgcccccgcccctgaacctgcacaatcagcgtgccttcgtttttgaggttgcccgacagcaacacacccgccgccaacaactcacccaaagcgcggcggatggcggcgggatagtttttctgttttacaatgtgctgccacacgttttccagacggacgtgcagcccgcgcacgggcatatcgtcgaagataaagcgggtacgcacatcggcgcggttgatggcggtttgattcatgattttctctgactgattgttcggatggcggctatatggttgcggtcggcgcgaaaacaagacggacggcggatgcgcttcccaaattatcaataaattatataaaaatcaacatattaactcaatctaacaagccgttttttgccaaacagccgtttttttatatacaatcaacaagatattttcgactgatacagcataacatcgcacggcggcacgatgcctcctgcgcggaaacaccgatatggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactgatttcccaaggaatacgcaatgagtatgcccgaaatgcccaaatggtacgacgatgacggacagatcgtgtcctgtaccgaaaaggtcaaagtgatgtccgaaaatatggccgagctgtatcagacggcacaagacgcgtttgaagacgcgctgctgatgggttgcggcgaacgtcagttgcgcgattacctgctcgcgctgattgaaggtttggaaaatccctaccgcaaagtctgaacacgccccggttgctgcggcacggtttatccgtgccgtttttgcgtttgtgcgcggcttcggcttttcagacggcatatttgacgttatgattaaacagttaacaagatttatcacaacgccgtcaaaagacagacacacaacatgaacatcatccgcgcgctcctcatcatcctcggctgcctcgccaccggcgaaaccgccgttttcctagcaggcatcaaactgcccggcagcatcgtcggcatgggcgtgctgtttgcgcttttgcaggcgggttgggtcaaaacgtcttggctgcaacagcttaccgacgcgctgatgtcgaacctgacgctgttcctcgtgccgccctgcgtggcggtcatcagctatttggatttgattgccgacgattggttttcgatactggtttccgcctccgccagcactttgtgcgtactgctggttacgggcaaagtccaccggtggatacggggtattatccgatgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttgaacccgtttcagacggcatttcagcccatgctgtctgaacgccgacacactcgcaaggagaaccgttatggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgctgcccttctccaccggcgtgattctcgaaccgctgcccgcagacaaaatcatcgccgccctgcccaaaatgcagcctgccttctggaacgaagcggcacgcgccatcatgaccaccgacaccgtgcccaaagccgcctcgcgcgaaggcaaggtcggcgacaaacacaccgtccgcgccacgggcatcgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagcctcgcgctcgaactcgcccaagccatcgtccgcgacggcgaaggtgcgaccaagttcatcaccgtccgcgtcgaaaacgccaaaacccgcgacgaagcccgccaagccgcctacgccgtggcacgttcgccgctggtcaaaaccgcctttttcgcctccgaccccaacctcggcaggctgctcgccgccatcggttatgccggcgttgccgacctcgataccgacctcgtggaaatgtatctcgacgatattttggttgccgaacacggcggacgcgccgcaagctacaccgaagcacaagggcaggcggtgatgtcgaaggccgaaatcaccgtccgcatcaagctgcatcgcggacaagccgccgccaccgtctatacctgcgacctgtcgcacggatacgtttccatcaacgccgattaccgttcctgacccgacacggcttcagacggcatacataaaatgccgtctgaaccgccggacaacataccatgacctccacattcccccgccgcctcgcccgcaaaatccgccaaacccgccgcctgtcgcgcaaaagcatcgcctttctgttccttttggcaggttcggcactcgtcgccctgaccgcgctgttttttgcccatcttgccgattttgcgctggaactgaacgccaaactggttcaacaatacccgtggttcgcgtgggtcgcgcttcctttgggtttaccgcttattgcgtggctcacacgcaaattcgcccccttcaccgccggcagcggcatcccgcaggtcatcgcctcactgtcgctgccctacggcgcacagaaaacgcggctgatccgcctcgggcagacgctgctgaagattccgctaacctttttgggtatgctgttcggcgcgtccatcggacgcgaaggtccgtccgtgcaggtcggcgcggcagtgatgggcgcgtggggcgcgtggtgcaagaaacacggcttggcattcaaagggatgcaggaaaacgatttgatggcggcgggcgcggcgggcggtttggcagccgcgttcaacgcgccgctggcgggcgtgattttcgccattgaggaactcgggcgcggcatcatgttgcgctgggagaggcaaattcttttgggcgtgctcgcctccggtttcatacaggtcgccattcagggcaacaacccgtatttttccggcttcaacggcggcgtattggaacatatctttctgtgggtcgcactgtccggcctggtttgcggcgcggcgggcgggctgttcggacgtttgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccttcggactcgccgccgccaaatggctcgccaccgtattcagctattgggcaggcgttccgggcggcattttcactccctcgctgaccataggcgcggttttgggcgagcatatcgccgccatcgccgacatatcgcagggtgcaaacatcatcgtcctcatctgcatggcggcatttctggcgggcgcgacacaatccccgattacttccgccgtcgtcgtcatggaaatgacgggcggacaaagcctgctgttttggatgctaattgcctgcattttcgcctcgcaggtttcgcgccagttttcgccgcgtccgttctaccacgcatcgggaatgcgcttccgccagcgcgtgcttcaagaaaccgccgcccaaaccggcaatgcgcccgcaagaccgcaaacagcaaacagcaaaacgggaatgccgtctgaaaattaaaacgcccccgatcaaacgccggcagccgccttgatttgaataccgttccgccgccgcttgaaatttcagcaacaatgccgtctgaacgacagaatgcggttttcagacggcatttccccatcccgatattgcctaaacaaaaccgaagcgtttgctataattctattttttaccgcatacgcaccaatcatgtttcccgatttctcccaaaccctctccaaagaccgccacttcctgcgttccgccttcaaaaatcccaacaaatacggcggtttgtccaaaatcgaagaaaaataccgaaaatcgcacgaaatctttttgaagcgtttggcagccttgccaaaacccgaattcgacaacaccctgcccgttcacgagaagctcgaagaaatcaaaaaagccattgccaagaatcaggtaacgattatttgcggcgaaaccggttcgggcaaaaccacgcagttgcccaagatttgcttggaactcgggcgtggggcggcaggattgatcgggcatacccagccgcgccgtttggccgcgcgctccgtagcagagcggattgccgaagagctgaaatccgaaatcggcagcgcggtcggctataaagtacgcttcaccgaccacacctcgcgcgatgcctgcgtcaagctgatgaccgacggcatcctgctggcggaaacgcagaccgaccgttatctcgccgcctacgacacgattatcatcgacgaagcgcacgagcgcagcctgaacatcgacttccttttgggctatttgaaacaactcctgccgcgccgccccgatttgaaagtcatcatcacctcggcaacgatagacgcagaacgcttctcccgacacttcaacggcgcgcccgttttagaagtgagcggacggacgtatcccgtcgaaatcctctaccgaccgctgaccggcaaagacgaagacgacgcagaagtggagttgaccgacgcgattgtcgatgcggcggacgaattagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccaattcaaaaacaaagctagatattttgcaagaagcatgggaaacattattaccacacagaaaattacatattacagcagatgatattcaagtctctgctgtagataatgaggaattgtattctgcctcaaatatgagtgatggagagcgagcacttttctatattcttggacaagttttgtcagtagatgacggttctgtcttaatttttgatgagcctgaattacatattcataaatcaattatttcaaatctatgggataaaattgaagaattacgacctgattgttcatttctaatcattacacacgatattgaatttgctgcaactcgagtagctaaaaaatatgttatcagaaattattatccgacccctgcttgggatatttctgaagttcctgaaagtaattttgatgaagaaacaataacgatgattttaggtagccgtaagccaatattatttgttgagggcaacaataatagtttagatattgctacttaccgctattgttatcctgattggaccatcatacccaaaggggcatgcaaagatgtcattcaatcagtatcatcgctgaaaaaattaagtaatgaaatgccattactaaacttaaaatgttcaggtattgtcgatttagatagtagggatgaaagagaaattgaacaattaaataatttgggtatttacattttacctgtatccgaaattgaaaatctttttagcttaactgatgtagcaaaagagatattgaaactaaatcaatattcagatgaagaattactcaataaacttaatggatttaaatccgaactaattaaatatatagataatgaattaaaagacgataaattagacgaatttgttgtaaaacaggttcgacgtaaaattgataattatttaaaaaatattgatttatcctccaaaataacaagtactgatatgaaaaaatcattacttaatgaaatttctactttaacagaacagaaaattgaaacatggatttcagaaattaaaaatgaaattcaaagatgtattgaacagcaagatttggataaattacttactatatatgataataaaggactcttggctaaatcagcttgtgttttaaaaggaatgcgtaacaaacatgaatttgaaagctggataatgagaacattaaaaggaaggaataaagattttattgatgcaatcagacagaaacttccaattctggattaaataaaaccatctgaaaatttaccttcagatacagatatatttcatgaaaaatcatcaaactacactctctttccctacttcgagtagcctgaaaccttgcgcagacaaacaaggcctgtctgaagaccgcagccaataccgcctgaccaaactcggcgaacaaatggcgcacctgcctatcgacccgaaaattgcgcgtattttgttagtattattccgtttttaaaaatgcccgattcgcggtatatcaatgacggttttcaggtattgctggaattgggggcggtggaggccgtctgaaaataaaatctttctttataaaaaggcaggccatgtttcattttcagacggcctaaatcattgagaaactaaaaactattaaaaagggaatattgggttttaaaactcaatcggtaaatttttattgtgaaatattaatgatgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatgagtggcgtaaaaaccaataaagacaaatttagatgatgtcggggaagatgcccgaccgacaagactatgcaaaatatgaaaaaccaagtacgcggatcaggcatggatgcccgatccaatccggccaatgtttcagacggcctgcaaaacagttcgggtcatatcggtaccaacacgcgttaccgcctgaccaaactcggcgaacagatagcgcgcctacccatcgacccgaaaatcgcgcgcattttgctggcggcgaagaaacacgactgcatggcggaaatattggtgattgcgtccgcgctgtcgattcaagacccgcgcgagcggccgctagaagcgcgcgatgcctcagccaaggcgcacgagcgttttaccgacaagcagtccgatttccttgcctatctgaacatttgggacagcttccagcgcgaacgcgataaaggcttgtccaacaagcagctggtgcagtggtgccgccaatatttcctgtcgcacctgcggatgcgcgagtggcgcgagctgcaccaccagcttgcccaaaccgcgattgaaatgggtttaaccaccaaggaagccgctttcagacgacctcccgaagtcaggcagctcacgtcgtctgaaaatgcgggtgaccaagacctatctgctaaactcaaacaaaaacaactggataaaaagcaacaccgcgcccaaatccgcgccgccaaagaagcgggctacgaacaaatccaccgcgccctgctcactggccttatcgccaacgtcggcatgaaatcgcccgacggtaacgactacaccggcgcgcgcggcagccgcttccaccttttccccgcctccgccctgttcaaagccaaacccaaatgggtgatggcggcagaattggttgaaaccacgcgcctttacgcgcgcgacgtcgccgttatccagcccgaatggatagagcaggaagcgccgcacctcgtccgctatcattatttcgagccgcattgggaacaaaaacgcggcgaagtcgtcgccagcgaacgcgtgacgctttacggtctgaccgtattgccgcgccgccccgtgtcttacggcaaagttgcccccgaagaagcgcgcgaaatctttatccgcagcgcgttggtggcgcaggaatgcgatttgaaagcggatttttttgtccacaacaaaaagctgattaaagaaattaccgaactcgaacacaaatcgcgcaagcaagacgtgctggtcgatgacgaagccctgtttgcgttttataacgaacgactgcccgaaatggcttggaaagacgcgcaaggcagcgtttggggaagtgaagattccgtacggattattgaatctgacaaagccgagaggtcgtctgaaaatgagcgcaacgagtttcgtaaaaacaagcgtaatgggtctcgccaaaatgaaaatcacggcaacaccgtaggttgggttgaaaacccaacatcagccgcaactgcaaaaactgttgggtttgacaatccaacctacgctgcccaacaaaccaccccctcccccgtgggggagggtcggggagagggcaaaacagttgccgcacaaaccaacttttccgcaaccgcagcaaaccctctccctaaccctctcccgcaggagagggaacagagtgccgcagcttcaacgatttcagacgacctgcgtcctgcaaatctgcagcaaaccgccccctcccccgtgggggagggctggggagagggcaaaacagttgccacacaaaccaacttttccgcaacctcaacaaaccctctcccgcaggagagggaacagagtgcctcagcttcaacgttttcagacgacctgcgtcctgcaaatctgcagcaaccctctccctcccccgtgggggagggctggggagagggcaaaacagttgccacacaaaccaacttttccgcaacctcaacactttcagacgactccaaacccaaaaagcagcctgcaccccaaaaaaaccgtctgaaacccctacccctcgccgacatccgcaccttccaagcctggctcaaaaccgccgagcgcgacaatccgcgcctgctgttcctcagccgcgacgatctgatgcaacacgccgccgcacacattaccgaagaacagttccccaaattctggcaaaccgcagacggcaaattcaaactttcctaccgcttcgagccgcaccatccgctagacggcgtgaccatgaccgtgccgctgaccgtcctcaaccgcctgcacgcgccgtcgctcgaatggctggtgcccggcatgatacgcgaaaaaatccagttgcaaatcaaagcactgcccaagcaaatccgccgcatctgcgtgcccgtgcccgaattcatcacccaatttttaagccaaaaccccgaccgcaacgcccccatcctgccccaactcgcccaagccatcgccaaaaccgcaggcgacatccgcatattcgagcaaatcaaccaagacgaatgggccgcgttcaggctgcccgaacactgctatttcaacctccgcattatcgacgacggcggacaagagcttgccggcggccgcaaactgcacgaattgcaacaacaactcggtcaagctgccgccgttaccttccgtgacaacacccaagaatttgagcgcgacaacgtcaccgcatgggacatcggcaccctgcccgaatccatcaaattcgcacgcggcaaacaacagctcaccggctatctcggcctacaaaaagaaaaagacggccgcatcgccctgcgcctgtttgataccacagaagccgcagagcaggcacaccgtcaaggtgtcatcgaattgatgaagctgcaattaaaagagcaggtaaaggatttgaacaaaggcatccaaggcttcacccaagctgccatgctgctcaaacacatcaacgccgacactctgcgcgacgacctcacccaagccgtctgcgaccgcgcctttatcggcgaagacgagctgccgcgcaacgaaaaagccttcaaagaacaaatcaaacgcgcccgcagccgcctgcccgccgtcaaagaagccctcagccgctacctgcaggaaaccgccgccgtctacgccgaactcaacagcaaactcggcaaacacccattgacccaccttctaagactacgcctgcaaaccctgctcgccgccggcttcgccacccgaaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaacagacagcctgattaaacaaggtctccccatttcagacggcctcgccgcgtttaaatggatgattgaagaattgagggtgtcgctgttcgcgcaggaattgaagacaccgtatccggtgtcggtgaagcggctgttgaaagagtgggaaaaaattgaaaaataaaaaaacagcctgaaaagtttcaggctgtttttttatttgactaatcgaagtttcctatatctatttaagtccctctcaactaatccaaaagttaaatcagcaacatctttgggggatacgtttaaattttcagcaatctgttcaataccaatgccatcattttttaaaatagtaagcattttacgtaatgcgcttgatatttccctttccattggctctggttcgatagttcgatattttttctttgcaaacaaaggacaaagattgtgtatatacatcctatcagtaatcattcctaatttatgcatccgatatgctaaggcaacaagtgatacaccaaatcgtcttttgatttttaataaattttcaatagtgataggaacatgacgatataagcgtagtgcagcctccggcattaaaaaagctgaagcaaaggcattagcctctttttcgataatatcacgaggttcatcttctgtaatttcactatttttactatgttccatactgtatttatcacggattaagtgccctaattcatgggcagcatcaaatcgactacgttctgcagatttttgtgtatttaaaaatacaaatggatgattttcataccaagtacaaaaggcatcaatgtcctttgtatctaaagataatgaaaatacacgaacacccttaacttcaagtagggtgatcatattcggaataggttcattgccaagcccccattctaatcttagttcctgagcagcctcttcaggagaaatatcagaaaaatcaggcaatacggcttgacttagtgtaaattctgtctcgagccagtcatttaacaaaaaagccgtaatgctatgatttaatgcttgtttttcaagcctcttcgaggtgcgtgaacgagcacgaaaacttactgcctgagatttcaactcaggcagtctttcgtcattagtaaagaaatgaactggaaactctaataaattggctaattcatttaaatcaggtatttgctcatcttttacatagtttctaacctgtcgagcggtaatacctaataactcagctaattttgtttgcgtacaaccacgtttatccagcgcaaattccagtctctcacgattaaatgtctgcatgatttatcattcaaattatcctgctttttgttttctttcaaccaaaggctcatattcttcaacaggttgcttacgttcaagctcatcaaatttagttaaatcaacatcagctaatataattcgctgcttgtacccagttatttgatgactaacaaaaccactcggtaaagataattcaagttgcactttattatacttccagtgaaacagcagaacccaaaactgcacagtatcaggcaaatctagttttgaattacgaatagcctcctcaaatcccttacctttccttgcggttgtcattggcatcccgtgatgcctaccaacatctgaagtagcagtagccacaataatacttttagttcgacatggcgagagacatagaaatgcaccacccgaccaaggctcaagcgtccagccatctttacttaaatatacccttagagcaaatgtaatttctgcttgccgatacatccccaatgtatttctgtcagataatgctgctttgtcctgaatattattatgcgcagtaagtacaatctctttaagcatctcctgagataagtacttgctgatttcacttaaagcaatatcactattttgttgctcgactatttctcctacttcaaatgggaaaggttctgataatgcaaattccaccataaaaatttcctaattttatacgtaatgtttacacaatatatcaggaaatatgaaaacgtacaactatatctataaagcaattaataagtagcctgcccaaccgtgtccttatctttcggcacacccgacctgcaaatcacgcaaaacttggaatccgtgtgtagggtgtgtgcggtacatacgcacgcagtctttttaaaccacagcccttcccaactaaaccaaaaggtcgtctgaaccctattttcagacgaccttttgccactttgtaaaacaaatcttcccaccatcctctccccaaacatcgcccgaaccagtaaacttctcatatttcaacaactccttggaagcaaaccatgtctggtatctacctaccccgcctattcccgccccatatcgccgaacgcggcctgttgtattttcagcagggcaaggttctcgatgtccgaaaaacttccgccgggcattatcgggcggaggtgtgcggttcggaaaactattgggtatagttgaagctggatagtgatttgtatattaaagacgaaggctgcaattgtccttatatctaagagtgcaaacataccttaaattactatattgcataggcaaaatacaagcctataacgaattggaaacaaaatgccgtctgaaaacatcttcagacggcattataaaatctgttcaccttttcagatgagtaatgtacacccttatacaatttttgctactatgccccataaatccacggctaaagatatccttattatgtcctatgatttatcgaaacgacttgtaatcggcttagcatcaagtgccctattcgacttatccgaatcggataatatatttagaatggaaggggcagaaacctataggcaatatcagagagaaaaacaaaaccatcccctaaaaaaggcgttgtctttccatttattaaaaaacttctgtcaatcaatgaaataaacccaaacgacccaacgattgggtttattcttttatccagaaacaatccagatacagattacgagtcataactataggcttaatattacacgattctcattccatcaaggcggaaaaccgcacaaatactgaaacactatcgatcgatttgtaaacaagcctacttaagtaacttgcagtccttatcatttcctttaaaataatccagcccgtcactacacgaactggcggacttcttgcaaataaaggttactagattttcattcatcttaataataaaaggatttttatctttatctatggctaccgccttcaacatgaatttactgtctaaagccccgcgcgcgattccattcaaacggatacaaaagccttctgcctctttaatcggcaaacttggccacttggtagatgtttgtttaaacctcccattctgcagataaaacttttccataaaatgtgcattttctaacaaggctgcccgcactgcatttatctttgctttctcaacataattgcgatagctcggataaacaattaaagcaagtacagacaatatcaagaccactgatattaattcaaccagcgtaaacccccgattatcagtcattactttacttccaataagaacagattattcaacatatttctttgaacagacttactatcccattcaacagtatgcatatttcccactctattttttagcggccggtatagccggtttggctgggccttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaaacgagctgattattatatcagcattttgttcttggtcaagtgtgacgtcgccctgaatggattctgttccattcttccgttttgatttgtacagtattggtggaggcaaacgggatcgaaccgatgaccccctgcttgcaaagcaggtgctctaccaactgagctatgcccccgttcttggtgggtctgggaggacttgaacctccgaccccacgcttatcaagcgtgtgctctaaccagctgagctacaaacccggattctcttcttaagcgaatcttgccttcactcaagcttcttccgcatctttttcagtttaccgataagtgtgaatgcctaaagcctcttctttctctagaaaggaggtgatccagccgcaggttcccctacggctaccttgttacgacttcaccccagtcatgaagcataccgtggtaagcggactccttgtggttatcctacctacttctggtatcccccactcccatggtgtgacgggcggtgtgtacaagacccgggaacgtattcaccgcagtatgctgacctgcgattactagcgattccgacttcatgcactcgagttgcagagtgcaatccggactacgatcggttttgtgagattggctccgcctcgcggcttggctaccctctgtaccgaccattgtatgacgtgtgaagccctggtcataagggccatgaggacttgacgtcatccccaccttcctccggcttgtcaccggcagtctcattagagtgcccaactgaatgatggcaactaatgacaagggttgcgctcgttgcgggacttaacccaacatctcacgacacgagctgacgacagccatgcagcacctgtgttacggctcccgaaggcactcctccgtctccggaggattccgtacatgtcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttttgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgcttttctgaagaaatttttttaaaaatatttatctatttgtttataaatttaatttatatcagtcaattttattttccatacagaattcttccagtgcccgatggatattttcagtctgccattcgttttttaagggtgcaacaatttcgatttgtcggttttggtagtcaaattgtattttccatgcatacagaaacatggtttcggattctgttccgccgtataagctgtcgcccagaatcggactgcccaaacttttcatcgccactctcaattggtgcgttttgcccgtatgcggttctaggatgaacagccgcagtttttcggcgatactgatgctgtggaatcgggtaacggcgatattttctgtattgcgcgtcaacttccacattccacatctggatttttccattccgcctttaatccaaccctgctttttggacggcttgcggtcggacagtgccaaataggtttttttgatgcttttgccggcaaactgtccgctaagggcggacgcgctttctttgttgagggcaaacagtaaaatgccgctggtctgtttgtccaatcggtgcagcagccacacacgctctacgcccaactgtatggcgagtgttcgggccagtccggtctcgccgctgtcttggtggacggatatgccgcccggtttgttgatggcgacgaagtcttgatggcggaacaaaatttccaacatatccatatatgccttgcaaaaatagaagggttcaattttcgtgttgatgttcggcaaggattttttcgtacacagcttgcggcacgtagcggtggatcgtttccgtccagccttccggcccgaccagtcctttgaccatagtggacgacacttcggcgatttcgcgcggcggcatgaggaatacggtggatatttcgggggcgaggtcgctgttgatatggcgcatggaacgttcgtattcgtaatccgaagcagaacggatgccgcgcacgatgaatcctgcatctacctcacgggcgtaatgcaccagaaatcggttttcaaatacatcggttctgacgttgggaaacattttagtaatatcgcacaacatatcctgcctttcagcgacggtataggtgctgcgtttgtcggggttaatgccgatggcgacgatgagttcgtcaaacatagattgcgcctgccgtatcatccacagatgccccaatgtgggcggatcgaaactgccggcataaacggcgcggcgcggtgtattcggtaacatttgattcctcccggcttcatagtcggctgtgtgttggtgcgtgtgcatccgtattgtatgcccaaagtaaaatgccgtctgaagcattttcagacggcatagtcggacggcgttttaccggcatcaatcctcgccgtttaaagacaacaggatgttcagcaggctgctgaagatgttgtaaagcgagataaacagtgtcagtgccgcgctgatgtggctgtcttcgccgccgtcgatgacggtgcgtacctgccacataatcattaaggaactgaacaagacaaaaccggcggaaatggtcagggcgagtgcgggaatacccaaaaacagattggcaaccacggcgaccatcagaatgaccgcacctacggtcaggaagcgtccgagcgcgttcatatcgagccgggttcggcgcgccaaggcggacatcgttaaaaagacggcggcggtcatcgcggcggcaatgccgacgattttcgcaccgtcggcaatatggagcgcgtattgcagcacggggccgatcaatacgcccataccgaatgtgaataccatcagcagggtaacgccggtattgctgtaacggtttttctcgatgaagtggatcataccgtagaaaaacgccaacacgacggcaaaccctatccagcgcgaaccgaaggcggcgtaaaaattgaaaccggcattggcggcaagtgccgcgcctgcggaagccggaataaatgaaaatccgagcaggcggtaggttttctgcaggacggtgtttttagaaaccgtatgcgcggtgtagtcgtaaacgtcgtgttgcatatcatctgctcctgaaagcgcggttgggaataatgggggattttaacattgcccaatgtcaaaatttgtccggttgcgtgaagataaagttgtccggcgtattttaaaggccgtctgaagcagtttcggacagcctgtgttcaaaacggaaaaccgttattgcggaacgtatccctgaacggcatccgcgccgtcgccgaagaaatactgctccatctgctgagccaggtattcgcgcgcgcgcggatcggcgaggcttaaacggttttcgttaatcagcatcgtttggtggcgcgtccacgccgcccacgcttcttgcgatacgttttcaaaaatgcgcttgcccaattcgttgggaagcggcggaaatttcatgccttcggcttctttgttgagcttgacgcagaataccatgcgtgccatagcggattcctttgctgtgttcagaaataacggggtgattttaaccgattagggatacggacaaaagccttcttattcccgatgatagggatggttgtgcaggatggaaacggcgcggtagagctgctcggtcagaaagacgcgcaccatgccgtgcggcagggtcaggctggacaggcgcatcatcatgcgtgcctgctgtttgaggcggtcggtcatgccgtccgcgccgccgatgacgaagcagacgtgttcgccgttttgccgccagcttttgaggtgttccgccagctcgacggaggtcggtgctttgccgcgttcgtcaagaacgacgaggaacgcgccttgcggaatggcttcaaggatgcgtttttcttccgccgccataccttgggcggcattcacgcccgcgccgcgtttttcgggtttgatttctttgagtgcgtaggcgacgtcgcgtccgaagcgtttggcgtattcggcgacggcctcatcaacccagcgcggcattttggtgccgactgccaaaacggtgatgttcaatgctttctcccttacaggaaaatgccgtctgaaggttcagacggcatcgggaatcagtctgccgcgtgccacggcttctgcattccggcgtggaaactcggtttctcgccgccccagagggtgtcgatgtcgtagaagtcgcgcacggcagggagcatgacgtggacgacgaggtctcctgcatcaaccagcgtccattcgccgctgtcgccttcggtactgaggatttcaaaaccggcttctttcaaatcgacggcaacgttgttggccagtgctttgacttggcgcgtactgtcgccgctggcgataatcattctggcaaacagcgaagttttgtcttgggtttcgagaacggaaatgtctttggctttgatgtctccgagggcgttgacggcgaccccgaccattttttgcaggtcttgcagttcttgttcgttcattattttcctaacgggatgttttcagacggcattatagccgtttcttactgatttgactttatttttcatacaaaccgtgttcgcggatgtagcgtgcggcggcaggcgggatgccgtctgaaacgccttggccggcaaggttgcggcggatttccgttgacgacacattatgcatcggggcggacaagatgcggacgctgccgtcctgaagggacttgcccagccacgcgtgcagttcgcgcggggtttggtgcaggctgtcgccctgcctcatggcgacggcgatattggtttcgcgcacgagcatctgccattttttccatgtgtgcagcttcatcaggctgtcgctgcccatcagccaccagagttgcgcggatgggaactgctggcggaagatttggacggtatcaaaagtataggttgcaccttctcggacgatgtcgcaatcgctgacggcaaaacgcgcgtcttctgccgtcgccaattcgaccatggcaaggcggtcggcggcggaagcggaggctgcgtctttgtgatacgggccgcctgtcggcaggaaaacaaccgcgtccaagccgatttcgtcggcaaaggcacgggcgatatgaagatgtccgttgtgtatcgggtcgaaagtaccgccgaacaatccgattttcttcatgatgtttccattccttccgataagtccatgccgtctgaaacactgccgtccacaaccagcgtcagtttgccggtaacgggatggatgaccagtccgtgaacggcgatatggcgcggcatcagcggatggttacggataaggtccaccgtgtggcgcacgctgtcttcgacgttgtcgaaaccggtcagccagccgtcgaggtcgataccggcataacgcagggtttcgatacggtcttcgggaatccggctttcccggacgcgcccgaggaattcttcggcattcagcccctgcataccgcaatcgtgatgggcgatgaccataatctctctgaccttcagttcaaacacggcaaccaaaaggctccgcatcaccgaaccccacgggtgcgtaaccagcgcgccggcatttttaatcagcttggcatcgccgtttttcaaacccaacgcgtcgggcagcagcccgataatccgcgcatccatacaggacaaaactgccagcccgcgttcggggtatttgtcggtaaagtatttttcatattcgcccgactcgacaaactgccggttatgggcaaggatgttatccaactcgctcattttgccgtcctctgaaaaagggttcacattataacgtttccgtctgttttccgccttcgccgccgtccaacagcaggaaaatacccagcgcgaacgccgccaacagcaatgtcagcaccatcgcccgcgcgtaattatcctcacccgcgcgtcccaaataggcataaatcaaagtcgtcagcgtctgccattccggacgcgacagaaacaatgtcgccgcaaattcgcccacgcaggttgccgccgccaaagtcagaccgcgccgcaacgccggtttcaagagggggaacgtgatgcggcatgccgtctgaaagccgtttgcacccaaacccgccgccgccctgccgtaatccggcggcagtgcatcccaggctgataaaacatcttttgccacaaacggatacgccagcagcgcatacatcgccagcagcaacggcaacgaagccgtccactgcggataaagcagcagcacgcccgccgaaacacaaaccggcgacaccataaacggcaaaaacatcagcccgcgcatccacgccgaccgccgcgccgccgccgcatacaccacacccaaaaccgccgccgcatacaccgccgccgccgagaagcgcaaagtattccacaccgcctgccacgtttcactttccattaacacacgccacgattcgccggccgaccacgctttcacaacaattgccaacaaaggaaacaggcagcacacagacaacaccgccgccgcaaacgccagcagcacatattccccgaccgactgcggcggcgacggcatcacaggggaaaccgccttatccgaaaccgcgcgcctgccgaaccacgcatacagcaaccctgccgccgccgttacccccaacaccagccacaccagcaccgaagcaaccgccatatcgagttcgaacatgaccaactggtaaatttccacttcgaccgtggcataacggctgccgcccagcagcagcgccagcccgaacccggaaaaacaatacagaaagacaaggcacacgccgccggcaagccacgggcgcaaaacgggcatttcaatgtcccaaaaccgccgccacgcccccgcgcccaacgtccgtgccgtctgaagccgtgccgcaggcacttgcacaaacccctgatacgccgccctgaccaacacaggaaggttgaaaaacacattgccgtacaacaacagatacggcgtatcctgcctgccgcgccacaacagcccgtccgccccgaacagggccagcacgcccacgcccgccaccaacgtgggcatcacaaaaggcagcatcagcaggcgcagcaccaaagcccgccccggaaacgccagccgcgccagcacccacgcgacaggcacgcccaaaggcagcaccagcacacaggttgccgctgcctgaaataccgtccacgccaaacgtttgagcatataggcatccgacagcaccgcgcgccacgccaaaccgtcatacgccgccaccgcccacaaaggcgcaacgaccattaccgccaaaaaagccgaaggcagcagggcaaaagcaccccataccacccaacgccgtccatccatcgccttccccacttgaaacactgatgttgcgattgtacccaaaagcccccacataccgtatatttcaatccgactacataccgtatccgccttcctcccgccgtctgaaatatagtggattaacaaaaatcaggacaaggcgacgaagctgcagacagtacaaatagtacggaaccgattcactcggtgcttcagcaccttagagaatcgttctctttgagctaaggcgaggcaacgccgtactggtttttgttaatccactataaatcgttcaaataaacaggaatataacttcagacaaacaacttaccgcccgatttgtgctatcgttttcgcacaacttaaaaaaacctgacaattttgtacttttattacagagaaaggctttacaaatggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacatactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctgacagacggaaaggatagtaaatgactacgcattttgtcgttatgggcgtatgcggctgcggcaagaccaccgccgcgctgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggtgcgaaccacaccatcgtaacctgttccgccctcaaacgcggctaccgcgacattctgcgcggagccgaaggcaaagctgccttcatccacctcagtccgccgcaagacatcaacctcgagcgcatgatgtcgcgcaaaggacattacatgaaagcagggatgctcgattcgcaactggaaatcctcgaggaactgggcgaaggcgaatacggggtcaaaatcgccaaccccggcacgcccgaagcggtcgaagccgatattctgaactgggttgcctcggaaaacctgctttgaagcaatatgccgtctgaagcccgacacaggatgggtttcagacggcataaacatcgggaacagaatggattacattgatttatagtggattaacaaaaaccagtacagcgttgcctcgccttagctcaaagagaacgattctctaaggtgctgaagcaccaagtgaatcggttccgtactatctgtactgtctgcggcttcgtcgccttgtcctgatttttgttaatccactataaaatggaaaatacccggctatcgtctcattttcgttttaatcagccataaaaatgccgtctgaaaccctttcagacggcatttctgtcaaacgccggacgcactcaacccaaactcaacagcaggttgcggaacgcgttcgggtctttgataaacgtcatctcgcccgcctgcggaaaatgaaaatccaacaggcgcgacacccaaaaacggatgcagccggcacgttgggcggtcgggaaatacgccttttcttcggcactcaaggggcgcacgccctcataaccgccgataaacgcctttttcaacgcctcatccaacttattgtccgccgtccttgcccaatcgttgaccgcaatcgccaagtcatacataaaattgccccggcaggcgtaatagaaatcgatgaagcccgatacctgaccgccgtcaagcaacacattgtctttaaacagatcggcatggatgatgcccgaaggcagatgattgccgagattgtccttcaacgcatcgatttcggaacacagcagtgcggcatcgtcttgcgacaggacgggcagcagccgggcgcacgcctccgtccaccacgcattgtaacgcgggttttccatttccaaagggaaatcggcggcggcaaggtgcattttcgccaacatcgcaccggtatgaaaacactgctcagccgtcggcagcgcggtatccgaacctttcaggcaggcaaccaggcaggcaggcttacccgccaaaacggaatcaagccggccgtctttgcgcgcaaccggcgcggcaaccgccacgcccttcatactcaaatgccggttaagctccagaaaaaacggcagctcttcctgtttcaacacttcaaacacggtcagcacataacgtcccgaagtcgtcgtcagaaaataattgctgttggtaatcccctgcgcgatgccctgcagggaaacaaattcccccaaatcgtaaccgctcaggaagccgcgcatttcatcatcggaaacactggtatagacagacatatcaactcacttgctcaaaaacgggcaaacccgccgtcagaacgccggacggcaggcaaacatataattcacatcggtcgaatcgcacagggcataagtttgcgacaacacatggtaagtcatacccttcgtatccgccacatccaagcctgcctgacggcacattcgcgccagctcggcaggtgcgatgaattttttccagtcgtgcgtgcctttggggacaaacttcaacagatattccgccgccacaatcagatgcaggtacgatttcgggtttttattgatggtggaaaaaaacaccatgccgtccggtttgaccagattggcacaagcacgcacgatggcggcgggatcggggacgtgttccatcatttccatgcacgttaccacatcgaacgagtgcggttccgcctcggcaaggtcttccacgcggatacattcgtattcgatatcggcgacattgttcaaagccgcgtgcaggcgggcggtttccaacgactgctccgccatgtcgatgccctttacaaacgccgcgccgcgccgcgccatactttccgccaagatgccgccgccgcagcccacgtccaaaacccgtttgccgcacaaatccgcgtgtccgtcgatataatccagccgcagcggattgatgtcgtgcaaggttttgaactcgcccgacttgtcccaccatttgtcggcaatccggctgaatttggcgatttccccctcatcgacattatattttttgtcggacattttccctcccatctgacgaaccgcccactccaaaacccaagattatactatggaacacaatgccgtctgaaagccttttcgggcggcgcggcgcaaataccttacaaatccttacactttacggcataatggcggctcgctttttctggcagaaagacaaaatatgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataaaggcaaaatgccgtctgaagcccgccggcggcttcagacggcattgccgcaacaaacggcaaccgtattccggcacacagcgcattaccctgcccctcacgcacaaatcccgccccgacaaaccgggacgcaaccataaaggaacaatgatgaagctcaaaatagacattgcaaccaacaacttcaaacacggcggcggcacggaacgctacacattggatttggtaaagggtctgaacagacaaaacatcacaccggccgtttatgcgacgaaatttgatcacagcattcctgaatacgccctaatcgaaccccatcttgtcgatcaacaccggacgctgaaaaaactacgctcattcctcttttcaagccggctcgctcaaaccagaaaaaacagtgccgccaaactgattgcctgccaccacgccgattacgccgacctcctcatctgcggcggcacacacttgggctacctgcaccatatggcgcaaaaaccgaacctgctcgaccgcctcgccatacgccgcaaccgcagcaactacgccaccgccaaactgattatggcgcattcccatatgatgcggcgcgaactggtcggactgtacggcgttccccctgaaagaatccaagtcgccccccccccccgcagatacggaacgcttctttccacaacccggagaaactgccgacctgcgcgccaaatacggctttgccgaccatgaaaccgttttcctgttcccatcgaccggccacacgcgcaaaggtctggaactgcttgccgactttttcgaacataccagcctgcccgtcaagctcgccgttgtcggctccccgcttccccgccctatgaaaaacgtcgtcggactgggcttctgcaccgatatgcccgaactctaccgcgccgccgactttaccattatggcttccctgtacgaacccttcgggctggtcggcgtcgaatccgtcctatgcggcacacgcgtcgtcctctccgaaaacatggcatgtacagaggtcatgaacgaagaagccggcttctttttctcacgccaaaacccggaaaccctggcgcaagccgttgcccaagccgtcagccttaaaaaacagggcggacaccgcctgtccgacccgatgcgggcactgaactacaacccggctttagacaaacacatcgggctgattcttgaaatgcttgccgcctgaccgcgtccccaaacggcattgccccgcaacttccgcgccgagacttttgcagcggaaaatacgtccggcagaaaatccgccgttgcaggagcaggcaggaaaacatcggcaaccgcccccgaaacgccgtacccgcgcattgcaagcggttgccggaacaggcgcgttatcgcgcggcacaggcgcatttccaccgatatttcagtataatgccacccccgacctgccccaatccaaaggaaacgcgatgaaactcatcattctcgaccgcgacggcgtcatcaatcaggaccgcgacgacttcgtcaaatccgttgacgagtggatacctgtcgaaggcagcatggatgcggtggcatttctgacgcaggcaggctacaccgtcgccgttgccaccaaccaatccggcatcgggcgcaaatattttaccgttcaaaaccttaccgaaatgcacgccaaaatgcaccgcctcgtccgtcaggcaggcggcgaaatcaacggcatctggttctgcccgcacaccgatgccgacaactgcaactgccgcaagcccaaaccgggtatgattgaagacatcatcggacgcttcaacgcccaagcctcggaaacctggctggtcggcgacagcctgcgcgatttgcaggcaatcgatgccgtcggcggcaaacccgcgctggttctgaccggaaaaggcaaaaaaacgctctcccaacacggacacgaattgcccgaacacacacaggttttcgataccctgctcgatttctcacaatacatcatgcaggaaaacaccgcaccgcaagccgactgaacataccgcattccgacaaggcaaaaccatgctcatcatccgcaacctgatttactggctgatactctgttccaccctgattttcctctttccctttatgctgctcgcctcgcctttccgggacggggcgcacaagatggcgcgggtctgggtcggcattctcaactggtcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggtgcgcaaaaacgaaggctattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatggaaaaatgcgaacatctcatcgaaacgcaacaaccgcttatttccggcgcaggcccgtttgccgccaaaatgccgtctgaaaccgcatgaccgcctttgtccacaccctttcagacggcatggaactgaccgtcgaaatcaagcgccgtgccaagaaaaacctgattatccgccccgccggcacacataccgtccgcatcagcgtcccaccctgcttctccgtctccgctctaaaccgctggctgtatgaaaacgaagccgtcctgcggcaaacactggcgaaaacaccgccgccgcaaactgccgaaaaccggctgcccgaatccatcctcttccacggcagacagcttgccctcaccgcccatcaagacacgcaaatcctgctgatgccgtctgaaatccgtgttcccgaaggcgcacccgaaaaacagcttgcgctgctgcgggactttttggaacggcaggcgcacagttacctgattccccgcctcgaacgccacgcccgcaccacacaactgttccccgcctcctcctcgctgacctctgccaaaaccttctggggcgtgtgccgcaaaaccacaggcatacgcttcaactggcggctggtcggcgcaccggaatacgttgccgactatgtctgcatacacgaactctgccacctcgcccatcccgaccacagccccgccttttgggaactgacccgccgcttcgccccctacacgcccaaagcgaaacagtggctcaaaatccacggcagggaacttttcgccttaggctgacgcggaccggaccgacccgccgctttcagacggcatccgtgccggaacaggcacgcgcccgcccgattcaaaccgcgatgacgctttgccgccggttcggggcaggatggcggcacacacgccgtctgccgcgtttcatttcacaccgctcttccgaaacccgaaacccgcccggtccgacgtgcggtatgaaacgcttaagctgacgcgaagtcttttactgatttgcccgcgaaaatgccgtctgaaaggttttcggacggcattttttttgcgtttcccaggatggcggcggattcgtaaaaggcggtcagggtggattgtaggatgggttgagacctgccgaatccgccgcatctgccaaatctaccgccgtcattcctacgaaagtgggaatctagaacgcggggttaagaaaacctgcatcccgtcattcccacgaaagtgggaatccagttttttgagtttcagtcatttccgataaattgccttagcattgaatgtctagattcccgactgcgcgggaatgacgaatccatccatacggaaacctgcaccgcgtcattcccacgaaagtgggaatccaggacgaaaaatctccagaaaccgttttatccgataagtttccgcactgacagacctagattcccgcctgcgcgggaatgacgaatccatccatacggaaacctgcatcccgtcattcctacgaacctacattccgtcattcccacgaaagtgggaatccagaatcccagactttcagataatctttgaatattgctgttgttctaaggtctagattcccgcctgcgcgggaatgacgggatttgaggtttctgttcgcgtcattcccacgaacctgcatcccgtcattcccacgaaagtgggaatctagttttgtcggtgcggaaacttatcggatatagtggattaacaaaaatcaggacaaggcgacgaagccgcagacagtacaaatagtacggaaccgattcacttggtgcttcagcacctgagagaatcgttctctttgagctaaagcgaggcaacgctgtactggtttttgttaatccactataaaatggtttctttagattttacgtcctagattcccgcctgcgcgggaatgacgattcgggcactcctgacagggtaaattcacaggatagcgattcgtagcaactgcatcccccccccccaacaactccccaaacaacgccgctcgccctgggcgtttgccgtttccctgcaaaatctgcgatacaatgcagtctgaacatttatccgaatcccaaatccgatggataccgcacaaaaacaacgctgggcaataaccctatcctatgacggcagccgcttttacggctggcagaaacaggctgacggcgtaccgaccgttcaggcggcattggaaaccgcgctcgcccaaatagcaggggaagcggtttccaccaccgttgccggcaggaccgacaccggcgtgcatgccaccgcccaagtcgtccacttcgacacaactgccgcccgtccccaacaggcatgggtgcgcggcgtaaatgcccacctgcccgaaggcattgccgttttgcacgcccgacaggtcgcccccgaatttcatgcacgatttgacgcatacggacggcactaccgctacctgctcgaatccgcccccgtccgttcccccctgctcaaaaacagggcaggctggacacacctcaaactcgacatcgggcagatgcggcaggctgccgccttattggtcggcgaacaagacttctccagcttccgcgccgccgaatgccaagcaaaatcccccgtcaaaaccatctaccgcgccgaccttacccaaagctcaggactcgtccgcctcgatttgcacggcaacgcctttttgcaccacatggtacgcaacatcatgggcgcgctcgtttatgtcggcagcggcagactcagcgtcgaaggcttcgccgcactgattcaagaacgcagccgcctcaaagccccgccgaccttcatgcccgacggactttacctgaccggcgtcgactatcccgaggcatacggcatcatccgcccccaaatccccgaatggctttaaaacatgcttgtcgcggagattttgaaatcggacaaactgtcaggcaatctttttccatgttgacactacctcatcaaggtactaacattgttattacataaacaggtgaatatggtacgtatatgattctcaacatacgcaaaatgggaaactcgcaaggcgtgattctgcccaaatcattattgggtcaaataggggcagtagacagcttggctgttacagttgaaaagggcaatattattttaagctgtcctaccgttcgcaggggatgggcagaagctgccgcaatgcttgtcgaaaccgagcaggagcattttttttccgaaattgaaaacgaagcggataaagaatggatatggtagtacgcggcggaatctatctggtctccttagacccgaccgtaggaagcgaaatcaaaaagacacgtccttgtgtcgtagtctctcctcctgaaatacacaactatctcaagactgtgctgatcgttcccatgacgagcggaagccgtcctgccccgttccgcgtcaatgtccgctttcaggataaagacggtttgcttttgcccgaacagattagggctgtggataaagccggattggtcaaacatcttggcaatttagacaacagtacggctgaaaaactgtttgcagtattgcaggagatgtttgcctgattgaatagtctgaatggattgtgttcattatagtggattaactttaaaccagtacggtgttgcctcgccttagctcaaagagaacgattctctaaggtgttgaagcaccaagtgaatcggttccgtactatttgtactgtctgcggcttcgtcgccttatcctgatttttgttaatccactataaagaccgtcgggcatctgcagccgtcattcccgcgcaggcgggaatctagaacgtggaatctaaagaaaccgttttacccgataagtttccgcaccgacagacctagattcccgcctgcgcgggaatgacgggattttaggtttctaattttggttttctgtttttgagggaatgacgggatgtaggttcgtaagaatgacgggatataggtttccgtgcggatggattcgtcattcccgcgcaggcgggaatctagaacgtggaatctaagaaaccgttttatccgataagtttccgtgcggacaagtttggattcccgcctgcgcgggaatgacgggattttaggtttctaattttggttttctgtttttgagggaatgacgggatgtaggttcgtaggaatgacgggatataggtttccgtgcggatggattcgtcattcccgcgcaggcgggaatctagaccttagaacaacagcaatattcaaagattatctgaaagtccgagattctagattcccgcctgagcgggaatgacgaaaagtggcgggaatgacggttagcgttgcctcgccttagctcaaagagaacgattctctaaggtgttgaagcaccaagtgaatcggttccgtactatttgtactgtctgcggcttcgtcgccttgtcctgatttttgttaatccactctaaagaccgtcgggcatctgcagccgtcattcccgcgcaggcgggaatccagaccttaaggcagcggcaatattcaaagattatctgaaagtccgagattctagattcccgcctgagcgggaatgacgaaaagtggcgggaatgacggttagcgttgcctcgccttagctcaaagagaacgattctctaaggtgctgaagcaccaagtgaatcggttccgtactatttgtactgtctgcggcttcgtcgccttgtcctgatttttgttaatccactatctcctgccgcaggggcgggttttgcatccgcccgttccgaaagaaaccacgtgcgcgttttttgccgtctttataacccccggtttgcaatgccctccaataccctcccgagtaagtgttgtaaaaatgcaaatcttaaaaaatttaaataaccatatgttataaaacaaaaaatacccataatatctctatccgcccttcaaaatacacatcgaattccacacaaaaacaggcagaagtttgttttttcagacaggaacatctatagtttcagacatggaatcgccgaaaacgtcggcggtaaatgcaaagctaagcggcttggaaagcccggccggcttaaatttcttaaccaaaaaaggaatacagcaatgaaaaaatccctgattgccctgactttggcagcccttcctgttgcagcaatggctgacgttaccctgtacggcaccatcaaagccggcgtagaaacttcccgctctgtatttcaccagaacggccaagttactgaagttacaaccgctaccggcatcgttgatttgggttcgaaaatcggcttcaaaggccaagaagacctcggtaacggcctgaaagccatttggcaggttgagcaaaaagcatctatcgccggtactgactccggttggggcaaccgccaatccttcatcggcttgaaaggcggcttcggtaaattgcgcgtcggtcgtttgaacagcgtcctgaaagacaccggcgacatcaatccttgggatagcaaaagcgactatttgggtgtaaacaaaattgccgaacccgaggcacgcctcatttccgtacgctacgattctcccgaatttgccggcctcagcggcagcgtacaatacgcgcttaacgacaatgcaggcagacataacagcgaatcttaccacgccggcttcaactacaaaaacggtggcttcttcgtgcaatatggcggtgcctataaaagacatcatcaagtgcaagagggcttgaatattgagaaataccagattcaccgtttggtcagcggttacgacaatgatgccctgtacgcttccgtagccgtacagcaacaagacgcgaaactgactgatgcttccaattcgcacaactctcaaaccgaagttgccgctaccttggcataccgcttcggcaacgtaacgccccgagtttcttacgcccacggcttcaaaggtttggttgatgatgcagacataggcaacgaatacgaccaagtggttgtcggtgcggaatacgacttctccaaacgcacttctgccttggtttctgccggttggttgcaagaaggcaaaggcgaaaacaaattcgtagcgactgccggcggtgtcggtctgcgccacaaattctaatctgcaaagattggtatcaacaaaaagcctgtcgccagacaggcttttttctgtttggctttttcctgttttctgtttggctttttcctgttttctgtttcgctgttttctgtttcgctgttttctgtttcgctgttttctgtttcgctgttttctgtttcgctgttttctgtttcgctgttttctgtttggcttttttctgtttggcttttttctgtttggctttttcctgtttttagtcttttttattcaatgtcaaaatatgccgtcattcccgcgcaggcgggaatctagtgcgttgagtttcagctatttagaataaattttgaaactttaatcccgtcattcccacgaaagtgggaatccaggacgcaaaatctcaagaaaccgttttacccgataagtttccgcaccgacagacctagattcccgcctgcgcgggaatgacgggatttgaggttgcggcatttatcgggagcaacagaatccgctctgccgtcattcccacgaaagtgggaatctagttcgttcggtttcgcttgttttaagtttcgggtaacttccacttcgtcattcccgcgcaggcgggaatccagtgcgttgagtttcagctatttagaataaattttgaaactttaatcccgtcattcccacgaaagtgggaatctagttttttgagtttcagtcattcccgataaattgccttagcattgaatgtctagattcccgcctgcgcgggaatgacggcggaaagattctatttttcccgataatcgcccacaatctcaaattccttcattctctcaaaaacaaaatcagaatcctaaatcccatcatccccatctatgtgaatataaaaattttaaaaattatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatattttcacaagcgaaagaatgccgtctgaagccttttttccggttttcagacggcattttttgcttgacgtttaactgtaaatcttcgcgccttttttgacgaactcgaccgctttttcctccatgccctgccgttgggctttttgcttgtcggcgtagtcgcgcacttcctgcgtgattttcatcgagcagaatttggggccgcacatcgagcagaagtgggcgattttcgcgccttcggcaggcagggtttcgtcgtggaagctctcggcacgttcagggtcgaggcttaagcgaaattggtcgcgccagcggaactcgaaacgcgctttgctcagggcgttgtcacgtaattgtgcgcccggccagcctttggcgagatcggcggcgtgggcggcgagtttgtaggtgatgatgccggtgcgcacgtcttctttgtcgggcagccccaaatgctctttcggggtaacgtaacaaagcatcgccgtgccgtaccagccgatattggccgcgcctatgcccgaggtgatgtggtcgtagccgggtgcgatgtcggtaacgagcgggccgagcgtgtaaaaaggtgcttcaaagcagtgttgcagctcttcggtcatgttttctttgacgcgttgcagcggcacatggccggggccttcgatcatgacttgtacgtcatgtttccacgctttatcggtcaattcgcccaaggtgtgcagttcggcgaattgggattcgtcgttggcatcggcaatgcagccggggcgcaggccgtcgccgaggctgaacgatacgtcatacgctttcataatttcgcagatttcgtcgaaatgcgtgtagaggaaattttcccgatgatgtgccaaacaccatttcgccataatcgaaccgccgcgcgagacgatgccggtgaggcggttggcggtcatcggcacataacgcagcaacacgcccgcgtgtatggtgaaatagtccacgccttgctccgcctgttcgatgagggtgtcgcggaacaaatcccaagtcaaatcttcggcgatgccgccggttttttccaacgcttggtaaatcggcacggtgccgatggggacgggcgcgttgcggataatccattcgcgcgtttcatggatgtgcgcgccggtggacaaatccataatcgtgtccgcgccccaacgcagcgaccacaccattttttcgacttcttcggtcaggctggaggtgacggcggagttgcccaagttgccgttgattttgacacgaaagttgcggccgataatcatcggttcgagttcggggtggttgatgttggcgggaataatcgcgcgtccggcggcgatttcttggcgcacgaattcgggcgtgatttggtcgggatgggtcgggatgttcgcaccgaaactttgccccgcgtgctgttccaagagtttggcgtattccggtttttgggacaattcgtctaattttaaacgttcgcgtatggcgacaaactccatttcgggcgtgataatgccttggcgcgcgtagtgaagctgggttacgttgctgccgcttttcgcgcggcgcgggcgggtgatttggttgaaacgcagatgggcggttttcggatcgtgtgcgcgttcgatgccgtattcgctggagagcttgggcaggatttcggtatcgccgcgttcgtccagccacgcggtgcggatgtgcggcagaccttgtttcaggtcgatatgcgccgccgggtcgccgtacacgccgctggtgtcgtagacgggaatcggcggattggcttccgtaccttgcgccgtgtaggtgtcgtcctgacggatttcgcgcaaaggcacgcggatgtcgtcgcggctgccttgcagatacacgcgttccgagttcggatatttaaagcagatgccgatgtcttcgctcaagtcggcaagctcgcgcgcttcgttgccggaagttttggcggttttttttggcgtagtcataaaaaaatgctcctgttttctcgtttagaattaaagaaacaggagcgttttgcgttttcagacggcatttgaaaaccaatgccgtctgaaaagcagaatccgtgaaaactccccacgcaggtattatcccgatcgggtgtaaagggtatttctcagccgcctaaacatcaggcagcacccctgtttcaatgttaaccaaaattaaatcacgaacatgaacttttgtaaagaaaataatatttcaaatcaggcataaaccgccggacggcaaaattttatgatttttcgcggaagtaatgtttgacaacataaaaaatctgccgtatagtttcatcttctgacgcgggatggagcagcatggtagctcgtcgggctcataacccgaaggtcgtaggttcgaatcctgctcccgcaaccaaatatcaaacccctcggttcaatgccgaggggttttgttttgcctgtttcctgtttcctgtttcctgccgcctccgttttttgccggattttccttccggccgcaatatcggaacggcagaccgccgtctgtttgcggttgcaaattcaggcagtttggctacaatcttccgcattgtcttcaagaaagccaaccatgccgaccgtccgttttaccgaatccgtcagcaaacaagaccttgatgctctgttcgagtgggcaaaagcaagttacggtgcagaaagttgctggaaaacgctgtatctgaacggtctgcctttgggcaacctgtcgccggaatgggtggaacgcgtcaaaaaagactgggaggcaggctgctcggagtcttcagacggcatttttctgaatgcggacggctggcctgatatgggcggacgcttacagcacctcgccctcggttggcactgtgcggggctgttggacggctggcgcaacgagtgtttcgacctgaccgacggcggcggcaaccccttgttcacgctcgaacgcgccgctttccgtcctttcggactgctcagccgcgccgtccatctcaacggtctgaccgaatcggacggccgatggcatttctggataggcaggcgcagtccgcacaaagcagtcgatcccaacaaactcgacaatactgccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgcccgaaaccttcctgcctgaaaatcaggatggcgaagtggcgggttttgagaaaatggacatcggcggtctgttggatgccatgttgtcgggaaacatgatgcacgacgcgcaactggttacgctggacgcgttttgccgttacggtctgattgatgccgcccatccgctgtccgagtggctggacggcatacgtttataggatgcgccatgcttgaactgaacggactctgcaaacgcttcggcaataaaaccgtcgccgacaacatctgcctgactgtcgggcgcggcaaaatactcgccgttttggggcggtcgggctgcggaaaatccaccctgctgaatataattgcggggattgtccggccggacggcggggaaatatggctgaacggagaaaacattacccgtatgccgcccgaaaaacgccgtatctcgctgatgtttcaagattacgcgctgtttccccatatgagtgcgctggaaaatgcggcattcggtttgaaaatgcaaaaaatgccgaaagccgaagccgaacgcctcgccatggcggcacttgccgaagtcggactggaaaacgaggcgcaccgcaagcctgaaaaactttccggaggcgagaagcaacggctggcgttggcgcgcgctttggttgtccgcccttccctgctgctgttggacgaatcgttttccagtttggacacgcatttgcgcggcacgctgcgccgtatgactgccgaacgtatccgaaacggcggcatccctgccgttttggtaacgcattcgcccgaagaagcctgtacgacggcagacgaaatcgccgtgatgcataaagggaggattctacaatacggtacgcccgaaacattggtcaaaacaccatcctgcgtgcaggtcgcccgactgatgggtttgcccaataccgacgataaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgcggcacgccggggcggtatcgggcaaggatacggtacgcatccatatcgaagaacgggaaatcgtccgcttccgctgatgcttcttaaaaacaaaatgccgtctgaaaacctttcagacggcatttttttaccaaagcagccatatttttttatcagggctgcaaaattttatccgaaacaacaacaatcttttcatcgtcattcccgcgcaggcgggaatctagaacgtaaaatctaaagaaaccgtttttcccgataagtttccgtgccgacagacctagattcccgcctgcgcgggaatgacggattttaggtttctgattttggttttctgtttttgagggaatgacgagacttgagatggcggcatttatcgggagcaactgaaaccaccctgccgtcattcccgcaaaagcgggaatctagaacccaacacggcaaaaatttatccgaagcgacaacaatcttttcatcgtcattcccgcgcaggcgggaatccagaacgtaaaatctaaagaaaccgtttttcccgacaagtttctgtgccgacagacctagattcccgcctgcgcgggaatgacgggattttaggtttctgattttggttttctgtttttgagggaatgacgagacttgagatggcggcatttatcgggagcaactgaaaccaccctgccgtcattcccgcaaaagcgggaatctagaacccaacgcggcaaaaatttatccgaagcgacaacaatctgagacctttgcaaaattcctttccctcacaacagccgaaacccaaacacaggttttcgtctattttcgccccaaatacctcctaattctacccaaatacccccttaatcctccccggatacccgataatcaggcatccggtcgccttttaggcggcagcgggcgcacttagcctgttggcggctttcaacaggttcaaacacatcgccttcagatggctttgcgcactcactttaatcagtccgaaataggctgcccgggcgtagcggaatttacggtgcagcgtaccgaagctctgttcgaccacataacgggtcttcgacaaatatcggttgcgtttggtttgcgcctccgtcagcggacggttgcggcaggctttgcgcataatatagtggattaaatttaaaccagtacggcgttgcctcgccttgccgtactatctgtactgtctgcggcttcgtcgccttgtcctgatttaaatttaatctactataatgtgcagtttctcgatatagccttccgcatcggtgcgggtatgttgtttgtaaccgagtttgtagaggccgtttttcttgatccaacgcgcatcgctgtccttactccgtgtggtttggccgctgacttgtccttcttcatcgacttctatggcctgacgctgtttgccgtcggcggtctgaataatggtggcgtcaatgacggcggcggatgctttctctacttttaaacctttttcggtcagttggcggttgatcagtttgagcaattcggacagggtgtcgtcttgcgccagccagttgcggtagcggcataaggtgctgtaatcggggatgctcagttcgtcgaaacggcaaaacaggttgaagtcgatgcgggtaatgaggctgtgttcgagttcgggatcggagaggctgtgccattgtccgagcaggacggctttgaacatggacagcagcggataggcgggacggccgcggtggtctcgaaggtaacgggttttttgacggttcaggtattgttcgatcggctgccaatcaatcacttgatccaacttcaatagcgggaagcggttgatgtgtttggcaatcatggcttgtgcggtttgctggaagaaggtgctcatggaaaatctcctaaatgtcttggtgggaatttaggggattttgcaaagttttcaacaagtttccgcaccgacaaacctagattcccgcctgcgcgggaatgacgggattttaggtttctgatttcggttttctgttttaagggaatgacgagacttgagatggcggcatttatcgggagcaacagaaaccactctgccgtcattcccgcgaaagcgggaatctagaacccaacgcgacaaaaatttatccgaagcgacaacaatcttttcatcgtcattcccgcgcaggcgggaatctagaacgtaaaatctaaagaaaccgtttttcccgacaagtttctgtgccgacagacctagattcccgcctgcgcgggaatgacgggattttaggtttctgatttcggttttctgttttaagggaatgacgagacttgagatggcggcatttatcgagagcaactgaaaccactctgccgtcattcccgcgaaagcgggaatctagaacccaacacggcaaaaatttatccgaagcgacaacaatcttttcatcgtcattcccgcgcaggcgggaatctagaacgtaaaatctaaagaaaccgtttttcccgataagtttccgtgccgacaaacctagattcccgcctgcgcgggaatgacggattttaggtttctgattttggttttctgtttttgagggaatggccgattttgggtttctgtttcggttttctattttgcaagaatggcaaaatttcagattgcgggcattgttaagtatttctattttttacctgccgtatttatttccgccccttgaagtcggcttcttcctcgacagacacgctgttcatctgtttgatcagcttttccgacttctcttcgtcttcgcagcggatgactttcacaatatcactttcgagctgtccgacattgctgtgcagaatgatgtttttgacgggcaggatgttgttggggttcatggaaaaacggcgcagccccatacccaataaaacgcgggtaaacgcggtatcgcccgccatctcgccgcatacggatacgtctttgtccatgcggttggcggtacggatgacgtgttgcagcattttcagcacggcgggatggccgggctggtagaggtggctgacgctgtcgtcgccgcgatcgacggacaagatgtattgaatcaggtcgttggtaccgacggagatgaaatcgaccagtttcaaaatactgccgacggtcagcgcggcagacggaatttcaatcatacagccgatgccgactttaccgaaggcatcgccgcgttcggcaagctggcgttgcgcggtgtcgaggtggatgaggcactggcgcacttcggatacggaggtaatcatcggccacatcatccgcacggggccgtgtaccgccgcacggaggatggcgcgcatctgggtgcggaacatgaccggttcggcaaggcacaggcggatgccggtcatgcccagcgcggggttgaggctgccgttgggcgtgctgtttttcccgaaccagcgcgggtttttgtccacacctaaatcgactgtccgtatcgttacgcttttgcctttcatttttttgacaatcgcgctgtacacttcgtactgctcgtcttcagacggcatcgtatcgcggttcaggtaaagaaactcgctgcggaacagcccgatgccgtctgcgccgaggttgtgcagcggtttcacgtcttcggcggattctatattgcccacaagctcgatgcagaccccgtcggcggtggcggcggcggtttttttgagcttgttcaaatcgcgtttgtggctgcggtattcgcgggcacggcggcggtattcgttcaacaccgactcatccggcgcgataatcaacacgccgttgataccgtccacaatgaccgtttcgccttcggtaatcagtttgcgcgcgttgtgcagcccgacgacggacgggatgtccaagctcctgcccaaaatcgccgtatgcccggtggggccgccggcatcggtaacgaaggcggcaatgcgctgctctttaaacaaaaccgtgtcggcgggcgaaaggtcgtttgcaatcagaacggtttcgtcaaacaggttgtcggcaacttccaactcgttgccctgcccgatcaggttgttgtggatgcggcggacgacttgcagcatatcctgcttgcgttcgcgcaaataggcatcgtccatattgtcgaattgggcggcgagtttgtcgctctgctgcttcaatgcccactcggcgttgattttttgttcccttaaaatatcgacgggttcgcgcgacaaggtaacatcggtcaagagcatcaggtgtagcgagatgaacgcgcccaactcggtcggggcgttttcgggaatcgcgctgcggagctgttccaactctttgcgcgtggctttgacggcggcatcgaaacgttcggcttcggcatcggtgtccgcctccgcaacatcatactgcggcacttcctccgtaccgcgcgcaatcaggtgggcgcaaccgacggcaatgcctttgcccgccgccacgccgtgcagcacgatactcattattcgccctcgccgaagtagccgttgattaagtcggtcagggcgcgcatcgcttccgcctcgtccgcgccgtccgtctccagttcgatgaccgtacccttggcggcggcgagcatcatcagccccataatgcttttgccgttgacgcggctgtcgtttttcgtaacccagacttcgcttttgaattgggacgcggtttgggtgaacttgttggacgcgcgggcgtggagtccgagtttgttgatgatttcgatggattgtttgagcatttcgattcccgtgttatgtatatcggcagcagacgccgtttaaaatgttttcctgccctgccgcttcttcagacggcatcgccgctgcgccggcacaccaaatcttcgggcgcggacgtgatggcgaaaatgccttttaccgccgcctccctgacgcattcggtaaaggcggcaaggtcttccgccgccggcgaatattggacggccttaaccatcatcggcgcgttcagcccggtcaaaatcgccgatttgttttcgcgcacgaggcggcgggcggcattgcagggggtcgcaccgaaaatatcggtcataatcagcacgccgtcgttgtcgggaaattcctgaagcgcggcaatggcgttgttgttgatgtcgtcttggtcttccgtcggctgcacgccgagtatgcggacgttttcaggcagtccgcccggaaaaaaatgatgcgccagcttgcggtaggcttcgcctatggtttcgtgtgtgatgattaaaagccctatcatattatgcgtcctgttcctcattatcctgccggcgtatgggcgcgatgccgtctgaacagccttcagacggcatcgcgcccttattttccgcccaatgcgtaaatctcgcccagattgcgccagcagcccgccgcatccatgccgtaaccgaaaacataacggttcggcacatccagtccgacataatcggctcggataggcttgggtttgtcaatcagcttgttggcgaacaccgccgcacggcagcttgccgcacccatttccaaaagtttggcttgaatggcggacatcgtatgcccttcgtccaaaatatcgtccagcacgacgacgtgcctgccccggatttgttccgcatcgggcatacgcttccagttgaacgcgccgccctccagcttgtcgccgtaacgggaaacgtgaacataatcaaaatctaagggaaaacgcaacagcggcagcaactgccccgtaaacaccaccgcgccgcccatcacgggcagcagcagcggatatttgccgcccaaatcacgcgtaatctcgtccgccactttttgcagtgcggcacggcattggccttggtcgaacaaaagatcggcgttttcaagcatcgcctgtgtttcaaggcgtttggtttctaaatcggtcatatgtcggaatcggtcggtaaaaggaaaattataaaccaaagtatcggatgccgtctgaactgtcctgctcagcggtcggtacgcacgcgcacaaatgtggcaaatttcggcgtgcctttccgcgtaaagccacggtaacggtaggtaatcagtgtgccgattttgggcgggttgtcgcggtctttatctttgaaaccgctgccgatgcggaattcgccgtgccggtttttgcagccgaccgcgcccagccgtccggcgtttcgccctttgccctcatagtgccgcgttaccgtgcattcgtcgtcgtattggcttttcagcttcaataattggctgctcctgccgccgctgtaacgggattcgggctgacgcagcatcacgccttcgccgccctgcgcttcgatttgttttaaaaagtccatcgcgtgctgccggtcgcgcactttgatttgcgggatgatggtaatcggcgcgttcggatgcgttttcagccactgcgttgcgactgccaaacgttggtagaggttgccctgcgccttgggtacatcgaaaacgtgcaggcggatgccgcgccagtctgaagaaacagaacgcacggtagcggaaatctgctcgaactgaccacgtccgctatacaattcgccgtccaaaggataaggcggaaactgagcggtaaaacctttgggcggagcaaacgcgtagccctgacggctcatcaggtgctttccgtcccaataggcgcgcacgccgtcgagtttctcgctcatcgcccagccggcaatatcctgccctttgtattcctgcgccagcatcaaatccgccgcgcctgctgatgcagggatgaaaaccgccgtaaaaatcggtatgatgccgccgattgtcttcttaatcatctgattcccccaatatcaaaacgggcggcaaaccgccataaaacaaacggcaaacccgatgccgtctgaaaaaccgtttaggaacacgccgatgaccctacgttacgaaatcttccccgttacccccttccgccaaaactgcaccctgatttgggacgacgaaagcggcgaagccgtcctgaccgatgtcggcggcgacgtgccgttcctgctgcaagcgttggcaaaccgcaaacttacgctcacggcaatctggctgacgcacggccatctcgatcacgcgggcggcgtggtcgaaatgttgaaaacgcataaagtccctgtcctcgggccgcatccggacgatgaattcctgctccaatcgctgccgcaaaccaccgcgcaatacggatttcccgtctcgcccgcctttgcgccgaaccgttggctcgaagaaggcgaaacgctcacggtcggacgctatgcctttcaagtgctgcatattccgggccatacgccgggacatatcgtcttttattgtgccgaggcggaattgctgattgcgggcgacgtgctgttttacgaaaccataggcagaaccgattttccgcgcggcaaccacgccgacttaatcaataatatccgcaacaaattattcacccttcccgaaaccgtgcaagttgtcgccggacacgggcgtatgacttccatcggacacgaaaagcggcacaatccgtttttctaaccgccttccctacggtcttcagacggcatcatctgcactgatgccgtctgaaacacaaaaggctcagacaaccgccgccttgccggtgtacctcgccggacaaggctttggtaagtacttcaaacaaacccaaaatcagaaccagtacagttacgccgcgctttcggcattcccgccccggctgaaacaatatttttccgcacaagtcagactgcttcatcttctgccgcgtattccaaagattccgacaacgccgttgtttcattggaacgctcgaccaaatcccgttgaagttgtttgcctgccttcacgcccaacagacgcagtttctcggcgcgtccgaccagattcccgcgcccttcggcaagttgcttgaatgccgtctgaaaactgctttgcgcctgatcgatgcctttgccgacgctttcgagcgtctgtacgaagccgacaaacttgtcgtacagcttgccgccttcgtccgcaatcgccagtgcgttctgattttgctgttcgttgcgccaaatattcgccaccgtcctcaaagtcgccagcagcgtactggggccgaccagcataatccgtttgtcgaaacactcttggaacaagcccgcgtcattctgcaacgccaacaggtaggccggttcgacagggataaacataaagacgaaatccaatgtgttcacaccttccaaatcggtgtaatccttcagcgacaagcctttcatgtgtgcacggatgctggcaacgtgtgccgccagttcgcgtgccgccgtatccgcatccgccgcctgcgtgtagcgcacataagctgtcagcgagaccttggaatcaatcacaatctgcttgttgtcgggcaggttgaccaaaacgtcgggctggaggcggcgcgtgccgccgtcttcctcttttcggacggatgccgcctgaaccacatattcccgccctttctgaaggccggaattttccaaaaccgtttccagaatcatctcgccccaattgccctgaaccttattctgcgtaccggtcagcgcgttggtcagggcctttgcctcgctgtgcagctgcgcgttcaacccctgaagccgtttcaattcgttttccaacgtcagccgctcgcgcgattctttatcataggtttgcttgaccaactcgccgaaaccgtggatgcgttcgtttagcgggttcaaaacctgatggagctgctcgcggttctgctcggtaaaacggcggcttttttcttccaaaatcgtgttggcaagattttgaaactgatcgctcaaacttttgcgcgcctcgcccagcaaggacagcttctcttcagaagcaaggcgttcctgttcgatttgcgttgccaaacgttcgttttcaaccgccaaaccctgtgccttttcctgcaactcggtatgcgactgcctcaaccgctccgcttccgcctctttttcctgcaaatgggcaatctgtttttcggctgcggcaaaacggttgccgacatcggaaaggtcgttttgcacgtcgcggacagtttggcggctttcttccaaatcggtttcgattctttggcggatttggcgttccaaggcatattggtcggcaaacgccttccgttcctgtccgagctgcgttgccaaacgttcgttttcaaccgccaaaccctgtgccttttcctgcaactcgatatacgactgcttcagccgcgccgactccgcctctttttcctgcaaatgggcaatctgcttttcggctgcggaaaaacggttgcccaaagcataattttcgtcctgcaaatgccggtatttcccgtccaacaccgccaattccgacacggttttgccgtgtgcctgttcgacaaaatcacatcttgccgccttttccgccaggtgcgcgttcaaaccggcaaactcgccctgaaaccggcccttcatcagcaaccatgtaaacaacacgcccgacaccaacgccgccaaaggcagcaaaacagtcatcagttccatcaattatcctaatattcaaacattttcacaccggacaaaaccgccgcttattccgattctacctgtttgttcgacatagctccaaaaaatatagcggattggctttaaacctgttcgacatcgccttaccatgctgcttgcggtttcagaccttttcctaattcaatatcaatctgccacaaaccctgattaagttcccgatgtctgacatttttagaatgatgccgtctgaaatgttgcagctatgttcagacggcatacggattcaggcttttcaaacggcaggcaaaatgaaaaaagggcaaaccctaaaggatttgcccttttgttccaaacgcttagtgtacgtctttccaatattctttatttaggaagtaagccaaaggcagcataaccgcaaataggaaaatcatcacgacatagcctatacgtttgcgttgcagttgtgcaggttcgcccatgtacacaaggtaattgaccaaatcgcgtacatatgcgtcgtactctttttggatcactttgccgttaggcaggcggcggctgtgcaaaccggtagattcccaatacagcttaggcttcatctcgccgtgttcgtcttttaccataaccggctgacctttggcatccaactcaacggcttgaacaccttgttgctcccacaacgggtggggcataccgactttatcgaatacagtattgttccagccgctcggacgggtcggatctttatagaagccgcgcatataggcgtaaaggtagtctgcacctttggaacgcgcaatcaacgtcaaatcgggcggagcagcaccaaaccattttgccgcatctttcgggttcatcgccgaatgcatgacatcgccgacattatcggtggtaaacatcaggtttttcttgatttcttcgtcagtcaaaccgatgtctttcagacggttgaagcgcataccgcttgcagagtggcaagacaaacagtagtttgtaaagatttgcgcaccgtgctgcaggctgacttggtcacgcaggtcgatatcgactttttcgtagtgtccgccgccgctggcgacggctgcactcataggcactgccagcaataaggcagcaaaccagtttttcagagtttgtttcattttcgctgccctcatcagatattggttgcaaacaagtaagcaccaacaacggtaataccgacgtaaacaaagaacataattttttgtttagtagtgctcatggttacgcgttcaggaactggtttgttggtatccagtttggtatagaacggcatacccaggaagaatgcaaagtagacgaaagacaggatacgtgcaaccaaagtacgcgtatcagttgctaccattgcacccaaaatacccaaaccgatgaaggcaatgatgaacagaaccaatgcggttttgaagattgggccgcgatagcggacagatttaacctcgcctttatccaaccaaggcagcaaggcgatcagtacaactgctgcacccataccgattacaccccatacctgagtaccggcaaaggaaggaatcgcacgcagaattgcgtagaacggagtgaagtaccataccggcgcaatgtgcggaggtgttttcagcgcattcgctgcatcgaagtttggcgcttccaagaagtagccgccgccttcaggtgcaaagaacatcacggcacagaagacaatcaagaatatcgttactgccaatatatcatgcacaacataatacggaaaaaaaggtatgccatctagagggacaccgttttcatctttcagctttttgatttctacaccgtcagggttgttggaacccacttcatgcaaggcaatgatatgagccacaaccaagccgagcaataccaaaggtacagcgataacgtgcagggcgaagaatcggttcaaagtaacatcggaaacgttgaagtcaccgcggatccaagtggacaaatcaggaccgataacagggatggcggagaacaggttaataattacctgcgcaccccagaaggacatttgaccccaaggcagcaggtagcccataaaggcttctgccatcaatgccaagaaaatcagggaaccgaaaatccacaccaattcgcgcggttttttgtacgaaccgtaaatcagaccacggaacatgtgcagataaacgacgatgaagaagaaagatgcgccggtagagtgcatatagcggataatccagccgccggacacgtcgcgcatgatgtactctactgcggtaaaggcagcaggcagatggtaggcgttaaggttgccgtccggtttgtagttcatggtcaggaaaataccgctgacgatttgaatcaccagcaccagcatagacaatgagccgaagaaataccagaagttgaagtttttaggcgcatagtattcagacagatgctctttccacattttacttaatggaaaacgggcatctacccagcctaacaatgcttttgctttgctattggtttggtttgccataattatcgttccttattcttagtcttcgcccaccaagatagttgtgtcgctcaagtatttatatggcgggacaaccaggttggtcggggcaggaacacctttatatacgcggccggccaagtcgaatttcgaaccgtggcaggggcagaagaagccgcctttccagtctgcacccaaatcggcgggggcaatgtcgggacggaaggtgggcgagcagcccaaatgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaaagttttatgatatttctcaagactcaagccggattgttttcgtcaaaatggcacacttccaacccgaaaacctctgccgccgattctgccagcgcgcgtacgccgtaacgttccgtcgcgtgatgccctgccgaaatgaaagccgtacccgtttcattggcaaggtggtattgggcttcagagatttcccccgtcaaatacagatcgacaccttcgtctattgccgtctgaaaaaacccctgcgccccgccgctgcaccatgcaacccgtcggatttcgcgttcgggattgccgataacgacaggcttacgttgcaaaactgtttcaatatgcgccgccaatgcgccgagtgtcttggcttgtttcaggctgcccgagttgagcaggttttgttcgccgaaccgtttttctgtcgcaaaacccaatctgtcggcgagttgggcattgttgcccagtgtgggatgtgcatccaggggcagatggtagcctgccatattgatgtcgtgccgtaacagtgcggcaatccgttcttttttccaaccagtaacggtcggcaactcgtttttccagaacataccgtgatgtaccaaaagcaaatctgccttctgctccacagcaaaatcaatcgctgccctgcttgccgttaccgacgtaacgattttcccgatatattccctcccttcaacctgcaaaccgttaggggcgtaatctttaaacaacgctgtctgcaatgtttcattacaccaagtcagaaaatccctgcacaataccatcttttttcctaatcgctttaaacaagcgggcattctaatcgcaaaatgtccggaattcacatttttccgatttgcacccgcatatgaattattttaatatgcgccggttcaatatgccgtctgaagccccatggattccattatcgaattgcgccacctcaaaaccctgctggcacttgaagaaaccggcagcgtctcccttgccgccaaacgggttttccttacccaatccgccctttcccaccagatccgtatgctcgaaaaccactacggcacgccgctgttcgaacgcaaatccacgcccttgcgctttaccccggtgggcgaaaggctgctgcgcctcgcccacgaacttatacctcaagttgctgttgcagaatgggatttggcgcgaatcacggaaggagaggcgggagagctgcggattgccgtcgaatgccatacctgtttcgactggctgatgcccgccatgggcgaattccgcccgatgtggccccaagtcgaattggatatcgtatcgggattccaagcggatcccgtcggactgctgctgcaacaccgtgccgaccttgccattgtttccgaagcggaaaaacaaaacggtatttctttccaaccgctgtttgcctacgaaatggtcggcatttgcgcaccagaccatccgcttgccgccaaaaacgtttggacggcggaagactttatcggggaaaccctgattacttatcccgttcccgacgagatgctggatttgcccaaaaaaatcctgattccgaaaaacatcaacccgccgcgccgacacagcgagctgaccatcgccattatccaactggttgccagcagacgtggcattgccgcccttccctattggacagtcatgccctaccttgaaaaaggctatgtcgtccaccgccaaattactgccgacggactgcaaagcaaactgtatgccgccatccgtaccgaagatacggacaagagctatctgaacaatttttgccaaatcatacgcgaacgcggttttgcagatttgcccggactgagcgaactggaaccggtctgaccccttattcaaccatacccggcagtttttctattttttcatgtatagtggattaacaaaaaccagtacggcgttgcctcgccttgccatactatttgtactgtctgcggcttcgtcgccttgtcctgatttttgttaatccactatactgtttttgatttttgcccaatctgtaatctttagattgccaatgggaaaccgtctactacaaataaaaaaccctgcgataagcagggttttttgaatttccaacattaacgtttggagaattgttttgcacggcgtgctttgcgcagacccggttttttacgttcgacttcgcgggcatcgcgggtaacaaaaccagcttgagacaaggcgggtttcaacgcggcatcgaagtcgatcagggcacgggtaatgccgtggcggattgcgccggactggccggtttcgccgccgccaacaacattgactttgatgtcgaaagattcggcgttttcagtcagaaccaagggttggcgaacaaccattcggctggtttcccgtgcgaagaattcgtcaacgggacgaccgtttacgatgatttgacctgtacctttaatcaggaatacacgagccactgaacttttgcggcggcctgtgccgtagtagtatttaccgttcatgtcgcgtccttatttcagttccaaaactttgggttgttgcgcagcatgggcgtgttccgcacccgcatacactttcagttttttaatcatggcgtaacccagaggacctttgggcagcataccttttacagcttgttccaaagcgcggcccgggaattgctcttgcatttcgcggaaggtgcgttcgtagataccgcctgggaaaccggaatggcggaagtattttttatcttcgaatttggcaccggttacacgcagtttgtccgcattgataacaatgatgtaatcgccggtatcgacgtggggggtgtattcaggtttgtgtttgccacgcagacggctggcgacttcggccgcaacgcgacccaagactttgtcttgggcatcgatgacgaaccattcgcgcttcacctcgtggggtttcgctgaaaaggttttcatagtggaaatccagatagatatagaaagttgtaaattttaaagacaggattcgattttgtcaatcgcattaccgcgttacggaaggattttccggatttcggcagactgcatactgctttttcgggcggggcggcggccaatgtgaaaaaccgcatcgttgcgatgcggttttgaatgggaatccccgcgagagccgtttcggccgaatccgcttgaaccttgctgacaaggcggctgcctcgggtagtttcgggtgcgtccgcaaaaggacgctcgcgcccactactgctcccggcaaccttaagcgaacttattggttcaaaggaatatatgccttcgcggacaccgcagggaaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccgggcgtgcatgacttcgatgtggacttgttcgatgttcatcctttaatccttattgctgcgtttcctgccattgggggaggcgcgctgccagtgcgctgattttttccctgctctgttcgagcaggctgcggtatcgtgtattttcttctgtcaggctgtcaattttgttttgcaggtcttctttgagtttgccgacttggacgagcagggcttcgctgagttcgtcgacggcggtttcgtgttcgagtttttgccgctcgtgcgcccgtttgagttcggcgacggtttctttgaggcggcggttttcgctgacgagggtttcgaatttttgtaccaacgtataaacgctgctttcgagtttttcgatattttgtttcataaccttacctgtccgtatgccgtctgaaggcttcagacggcatctgtctgttgtttattcaaaacgcgcgctgcgttccatcagtctttcgacaacctgttgcggggtcatttctttgcggatgagttgcagcagagtttgggtaatcggcatgtcgatttggtacttacaggcagtattgaagacttcttctatcgtgctgaccccttcggaaacgtgtccgatttcgaccagcacctgatgcagttccttgccttctgccaaacccaagccgacgcggcggttgcgcgaaagtgcgccggtgcaggtgaggatgaggtcgccgatgcctgccagccccatcatggttttgggctgtgcgcccattgcggaggcaaggcgggtgatttcagctaatccgcgcgtaaccagtgcggcacgggcgttaagcccgtactctaggccgtcggacaatccggtggcaatcgccataacattttttaccgcgccgccaaccgccacgccgataacatcggtactgccgtaaagcctcatgacggtcgtgttgagctgcggtacgagttcttcaatccactcttggttttcggaggcaaggacgacggcgcagggcagttgtttggcgagttcctgtgcaaaactcgggccggaaagtacgccgattttcttattgtcgggcaatacttctttcaagacttgaaaggtcagcagcccggtatcctgctcgaatcctttgcaggcggcgaggacggggaggtgtcccgcgccgtactgtttgagcagctctgcgctgcttctcaatccggcaacggaggttacgataaggacaagtccgctgtctttgagcgcgtctgccaaatccgcacacacttccaaggtttcgggaaaggaaaagccgggcagtccgcgtttgttttcacgcgcttcctgcatttgacggacttggtctgcgttgcgcgtccacagggatacgcggttgccgtgttgggaaaaatgcagggcgagcgccgtaccccacgaacctgcgccgataacggtaattttcattggtcgtctttcaacatatcactgccgttcactttaaaacaatcggtgtttctctgcaagtgcggtcagggaaatgccgtctgaaaggcgttcagacggcattttgccccgatgcggcactatcagcctgtattgcgcaaaccttgcgccacgccgttgatggtcaggtgcaccatcagaagggcgtgcggattgtcgggttctttacgcaggcgtttgagcatggcgacttgcaaaccgttgagcgcgttcaggtagggaatcctcaaagcgagcgaacgggcgaggctgcggttgtcgcgcaaaagctcttcggtttgcagtaggtcgagcagtgctttgcggctgcggcggtattcttccttaatcatcccgaagatgatttttgccttatcgggcgattcgctcaagccggcatagttttccgcgagggtgatgtcggttttcgccatcacttgttccatattggagagcatggcttggaagaacgggttgctttgggcgtgttcgcgcagggcggcgagcgtttcgggtttgtcttcgcacaaggtttccaccgcgctgccgaaaccgtaccaagccggcagcatgaggcggttctgcatccaggaaaatacccacggaatcgcgcgcaagtcctgaatccgcgccaaggttttgcggctggcgggacggctgcctaggttgagggtggcgatttcctgaatcgggctggtttgcagaaagtagtcgatgaagtcgggatgggtaatcagttcgcggtagtatttgaacgatacgtccgacaatgcctgcatcagtttggcatcagggtcttttttatccggcaggatgctggcttccaaagtcgcggcaaccaaggtttccaagttgcgttgggcattgccggggtcggcgtatttggcggtaatgacttcgccttgttcggtgatgcggatttgtcccgccacgctgcccgccggttgggcgagaatggcttggtaagaagggccgccgccgcgacctacgctgccgccgcgtccgtggaacaggcgcatacggacatcgtattttttgaagagttcgaccaagcccaattccgcctgatagaggcaccatgagctggtaacgtagccgccgtccttgttggagtcggaatagccgagcatgatttcttggatgtttccacggctttcgagcagtgcatcgtaccagtcgaggcggaacatggtttccatgaccggacaggcgttttccaacgcttcaatggtttcaaacagcggcacgatattgatgcggctgtgcggtttgccgttttccaccgccaacaggccggtttctttcagcagcaatgccaaggcgagcaggtcgctgggttgttcgcagttggaaataatgctttgtgttacggcatcttcgccaaattcgtctttgattttgcgcgcttcgttgaaaattgccagttcgtggcgggtatggtcgctgtatgtgataaacgggctgtacagaggacgttgatggctcaattcgcgcaacagggcggtttgtttttgctcttcgttcaggcggttgtagtcttccaagcctgcgtgttggaaaagctcggcaaccacatcggcgtgtttgcctgcgtgttggcgcaagtcgagcggcatcatgtgaaagccgaacacggatacggaacggatgaggtctgccaaacggccttcggcaagcagacggctgccgttgtcgataagggaacgttgcaattttttcaaatcatccagaaactcttgtgccgaagcataaggctcgagaaagccgaatttgcagcccatacccaaaccgagcgcgcgcgctttgcccatagcgcgcgccataatgtaggcgatggcgcggcggtagggttcttcggcgcgggcgatttcttcgtcgggcgatttgtcggacaacgccgttacatcgccgttgactttgacgcggcggatggagagcggcagttcgcggtagagtttgtcgagttcgccgcgatagaagcggaacacggcatcggcgtggcggcggaaggcaaagcgcagggtttcggcagaaacaaacggattgccgtcgcggtcgccgccgatccagccgccgattttgaggatgtccggaacgcggacgccgggataggccgtctgaaagtcgtgttccatcttgcggtagagcttgggcagggcttcgaaaaagctcatcgggaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtgcagcgttcgcgttgcggcaacagtgcgcggatgcggcggttgaagcttaagacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgactgtttcgacaaccaacggcgaggcttcttcgtgcaggaggttgaacagggattgtttcagaaattccgcgtccgccgccaaagccgcgtcctttggattgttcagaatatgcagttgcatgatttttctctctcgtctgccgtaaatattgtaaatgtaccccaaatgccgcatccgtgccaaaccgttcacactttaaccgcccgtgtcccgaaatgccgtctgaagttgaacgccgcccgacggcagcgttacaatcgcccgcaactgtttttttccgaacatcatcatgaccacgaccgaacacgacaacgacgatgcattcctgctgcggtacagccgccacatcctcttggacgaaatcggcatcgaagggcagcagaaactttccgccgcgcatattttggtcgtcggctgcggcggtttgggtgccgccgcactgccctaccttgccgcttcgggtgtcggcacgctgaccatagccgattccgacacggtcgaactgcacaacctgcaacgccaagtcgcatttgacgagggcgatgtcggcaaactcaaaaccgaagccttggcaggccgcctgaaacgcatcaaccataccgtcaacgtccgcgccgtcaacgaaaaactcgacggctgccgcctgaccggtttggttcaagccgccgacatcgttttagactgttgcgacaactacgccacgcggcaagccgtcaaccgtgcctgcgtgcaaacgaaaacaccgctggtttcaggggcggcggtacgctttgaagggcaacttgccgtgtaccgtcccgacttgcccgactcgccgtgttacgcctgcctgtttgacggcggatcggcttcagacggcatctgttctctcttcggcgtgttctcgccgctggtcggcatcatcggcagtacccaagcggcggaggctctgaaaatcctgctggatgcgggcgaaccgtcgcacggcaggctggcggtttaccgtgccttggaagggggctggcaatatttcgacctgccgcgcaaccctgaatgcccggtttgcggcacagcgcgataaaccctgccgccgtttcagacggcatccaaacggatgcggcggaacggttttaaaaatttaaaaatttacatttctttgcaaaaaaaaaaaaaaaaaaataaacttaccttataattgcaattgttttagcaatgtctgtttcgcagactcattgagtaaaacgttttccccgtaatgtgtttggccgtctgtcccctttgggttcggacggcttttttttggctgtgtttgaatacccggttggttttatctgtttgcagcgggggaagccgcttatttccgttcgggcggaaaacggttccatcggataaaaggcattttgtccgactgattaaagttatagtggattaacaaaaaccagtacagcgttggctcgccttagctcaaagagaacgattctctaaggtgctgaagcaccaagtgaatcggttccgtactatttgtactgtctgcggcttcgtcgccttgtcctgatttttgttaatccactatatatcttaggtttgcatcggcggaatattcaaacacagccttttttaaggaaatccggatacggcggcgcatcaataatgcggcggaatctcgtcgcgcagggaatacggctcttgcgcgtcgggattcctgtcctgcattttttgatacagcagcctcaactgagcctgctgcaaatccagcgtctgccgcaattccgccaccatcgcgttcaggccggcgattacgtcctcctgaagcgcggattggatttccagttcgacaatacggcgttccaactcttgaaccgcgtccatttacagcaccatcgcggcaatccagccggcaatcagcagcgggatgttgtagtggatgaaggtcgggataacggaatcgcggatgtggtcgtgctgcccgtcggcgttcagccccatcgtcgggcccagcgtggaatcggacgcaggcgaaccggcatcgcccaacgcccccgccgtgccgacaatggcgacggtggcaagcggcgaaaaacccaaaccgacacacaaaggcacataaatcgcggcaataatcggcaaagtggaaaaggacgaaccgatgcccatcgttaccaaaagccccaccaccagcatcgccaatgccgccatacctttgctgttgccgaatatcgccatactgctttccaccagcggctgaatatgcccggtcgcattcatcacggcggcaaaaccctgcgcggcaatcataatgaagccgaccatcgccatcatcttgataccttcgccgaatacgtcgtttgccttgtcgcggttaatgacccccaacatcataaatacggcgaaaccgagcatcgcgcccaacaccagcgagtcttcatacatcaactggatggcaaagcatacggcaatggcgacggcggcggccaggctgcggtaggcggacggctgcggacggtttgccgcatcggcgttgcccgccgtatcggcattgttgctttggtacaggcgcggtttgcggtaatggacaaacgccagcaggagtccggccagcattcccaacgcgggaatcgccattgccgccatcacgttaatgtttttcacatcaagctgcggcgcggcggaatggatgttgcccaacaggatttcgttcaaaaaaatcgcgccgaagccgtaaggcaggaacatataagtcgtaaccagcccgaaagtgatgacgcacgcaatcaggcggcggtcgattttcaggcggttgaacaccaaaagcagcggcggaacaatcatcgggataaaggcaatgtggatggggatgatgttctgactcatcatgcccatcacaaggatgatggaaagcagcagccatttgaccgcgccctcgcccgaacgcacgctgtcgggcataccgccccggttcagcttgcggacgaccgcgccggcaagctgctgcggcaggccggaatgggtaatcgccattgcaaacgcgccgagcatcgcataagaaagcgcaatcttcgcaccgccttccaaacctttgttgaacacggggataatccccgcctgactgacctgtcccgccgcatcggcaatgttttgcagcggcatacccgccaccgcgccgccgacaaacgcgccgaccgtcaggctcaataccacgtgcacgcgcgacagcgacagcaccagcataacgattacggcaactacgactgcattcattgtttatcgctccaaacctataaatgtttacatatcgaaacacatcataacccaataacgggaaacccgccaattttgcaaacaattatttcaaatgcttcatatacttccccagcgtaaccctgtccaaacccgccaaatccggcagggtttccactcctgaaaaaccattctccgccaacacgccgcgcaccgccgcgccctgatcgaaaccgtgttccagcaataaaaaaccgccttccgccaaacggtcgggcgcgccttgcgccaaggtgcggatgcagcttaggccgtctgaaaagtcggtcagcgcgatttgcggctcaaaccgcaaatcgccttgcaacaaatgtttatcgccgttttcgatatagggcgggttggacacgatgatgtcccatttcccttcagacggcatatcggtgtcgaaccacgaaccgtgtgcaaattcgacccgcgcgcccaaatccgccgcatttttccgcgccgtttcaagggcgggcgggctgatgtcggatgcgcgcacaaacgcatcggggcgttcgagcgcgacggttacggcaaccgcgccgctgcccgtccccaaatcccacacgcgcccgttttcgggcaggcgcgccaatacggcttcgaccaaatgttcggtttcggggcgcggaatcagcacgctcggattgactgtaaagcgtctgccataaaattcgcgcacacctaaaatataggcaaccggctcgccgttcagacggcgttgcgccagcctgtccgcccgctgtcggacttcgtccggcatttcttccccgccccgcgtcaacaactgcacgcgcgtatattccgaaacatattgtagcagcattcttgcttcatttttaggcagttttgacaagcccaaccatttatcaaacgtcatttttatcccgtctgccgctgatgcggcttttctttccttattctttccggcaaacgtaccgatggtggcaaccgcaaatgcggcataccacaaataaaatcctgcaccgtagcgcacaatatccgatgtattccctgcttcatcgacgtatacggctttcacactgaaagccaccaacgccaagccccaaagtgccgcatggacaggcacgaccttcttccgcaacgccagcaaaacaatggccgccaaccaaacataattcgcatagaccgcacaatacctgatatccaaagaagcaaatatcgaccccaaaatcaaaacggtcaaaccctccatgcttccatgattgcccaaataaaatgcaacattggataaagacgctatccacagggcaaccgacaccagcaacatcactatgggaaaacttggtttccgattctgttcctgcatggttttatcctaatgtaaaaggccgcctgaaaacctttcagacggcatcgtgccggattccgcgtcagattgcgctgccgccgacggtcagtccggcatcaatccgcaaagtcggttgccccacgccgacggggacgctctgcccttctttgccgcacacgccgacaccgctgtcgagcgcagtatcgttgcctatcatggaaacgtgtttcagcacttcggggccgttgccgatgatggtcgcgcctttgacgggatattgcagcctgccgccttccacccaccacgcttcggacgcactgaacacgaacttgccgctggtaatgtccacttgtccgccgccaaagttgacggcgtaaatgcccttgtcgatggacgcgatgatttcttccggctcatagctgccgttttccataaaggtattggtcatgcgcggcataggggcggaagcgtaactttcgcggcggccgttgccggtggactgcgtacccgtcaggcgggcattggtttcgtcctgcatatagccgactaaaatgccgtcttcaatcaatacggtgcggcgggtttcgttgccttcgtcgtcgatgttgagcgaaccgcgccggccggcaatatcaccctgatcgacgacggtaacgcctttggcggcgacgcgctcgcctattctgccggaaaagacgctggttcccttgcggttgaaatcgccttccaaaccgtgtccgaccgcttcgtgcagcaacacgcccggccagccgttgcccaaaacgacggtcatttcgccggcgggcgcggggcgggattcgaggttggtgagtgcctgtttgacggcggcatcgacaaaccgatgaaccaagttttcatcgaaataagccaagtcgtagcgtccgccgccgcccgcgctgccctgttcgcggcgttcgccctgtttggcgataacggtaacgttcaggcgcaccatcgggcggatgtcggcggcgtgtttgccgtccagacgggcgaggtaaaccatatcgtattcgcaggtcaaaccggccatcacttgcacgatgcgcggatcggcggctttggcgattgcttccactttgttcaacagcgcgactttggcggcggaatcgaggccggcaatggggtcggacgcggaacaaaccggcttgccgcgcgtttcagacggcattttggcggacaccttgccgcctgccgccccaatcgcgcggacggcgcgggcggaacggtttatcgaatcgatgcacaggctgtcggcgtaggcaaaggcggttttgtcgcccgaaacggcgcgcacgcccacgccctgattgatttggaagctgcccgatttgacgatgccctcttccaaatgccagctttcataagcggtgcgctggcagtagatgtcggcgtaatcgacgtggtgcgcgccgatgatgcacaggcttttggcgagcagttcgggggaaaggcggttggcttcgagcagccgcgcctgtacggcggaataggtcggatgcatagtgtcggcgcataaaaaatcaggggcttgattatacggcatttgttatatagtggattaacaaaaaacagtacggtgttgcctcgccttgccgtactatttgtactgtctgcggcttcgtcgccttgtcctgatttttgttaatccactatagaaatgcgccgtgccgcctgaaatgtaagatttttgccaacgccccctgcttttgtgtacacttaaagctccttgtcggagtgccgccgccgggcggctgagattgcgaaagcagaatccgtagaacctgtcggggtaatgcctgcgtaggaaacaaaccgtcaaatgccttatcaggcttccgttcccttttccgcacttccccgccccattttcatgttttttaaggacttgatatgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctctccaccgttaccacaacgtttctcgatgcctattccgccggcgcgagtgcgaacaacatttccgcgcgttttgcggaaacacccgtcgctgtcggcgttaccctgatcggcacggtacttgccgtcatgctgcccgttaccgaatatgaaaacttcctgctgcttatcggctcggtatttgcgccgatggcggcggttttgattgccgactttttcgtcttgaaacggcgtgaggagattgaaggctttgactttgccggactggttctgtggcttgcgggcttcatcctctaccgcttcctgctctcgtccggctgggaaagcagcatcggtctgaccgcccccgtaatgtctgccgttgccattgccaccgtatcggtacgccttttctttaaaaaaacccaatctttacaaaggaacccgtcatgacccgtatcgccatcctcggcggcggcctctcgggaaggctgaccgcgttgcagcttgcagaacaaggttatcagattgcacttttcgataaaggctgccgccggggcgaacacgccgccgcctatgttgccgccgccatgctcgcgcctgcggcggaagcggtcgaagccacgcccgaagtggtcaggctgggcaggcagagcatcccgctttggcgcggcatccgatgccgtctgaacacgcacacgatgatgcaggaaaacggcagcctgattgtgtggcacgggcaggacaagccattatccagcgagttcgtccgccatctcaaacgcggcggcgtagcggatgacgaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgcgtccccgaaggcctgcaagcccaatacgactggctgatcgactgccgcggctacggcgcaaaaaccgcgtggaaccaatcccccgagcacaccagcaccctgcgcggcatacgcggcgaagtggcgcgggtttacacacccgaaatcacgctcaaccgccccgtgcgtctgctccatccgcgttatccgctctacatcgccccgaaagaaaaccacgtcttcgtcatcggcgcgacccaaatcgaaagcgaaagccaagcccccgccagcgtgcgttcagggttggaactcttgtccgcactctatgccatccaccccgccttcggcgaagccgacatcctcgaaatcgccaccggcctgcgccccacgctcaaccaccacaaccccgaaatccgttacaaccgcgcccgacgcctgattgaaatcaacggccttttccgccacggtttcatgatctcccccgccgtaaccgccgccgccgccagattggcagtggcactgtttgacggaaaagacgcgcccgaacgcgataaagaaagcggtttggcgtatatccgaagacaagattaaagccgcccgaaaggacaccttatgaccttcccgcccctaaaatccccgctcaaattctacgccgtcgtccccaccgccgattgggtggggcgcatggtcaaagcaggtgccgacacggtgcaactgcgctgcaaggccctgcacggcgatgaattgaaacgcgaaatcgcccgctgcgccgcagcctgtcagggcagccgtacgcagcttttcatcaacgaccactggcgcgaagcaatcgaagcgggcgcgtacggcgtgcatctcggacaagaagacatggacaccgccgaccttgccgccatcgccgccgccggtttgcgcttgggtttgagtacgcactccgttgccgaactcgaccgcgccctgtccgtacaccctagctacatcgccagcggcgcgattttcccgaccacgaccaaacaaatgcccaccgccccgcaaggcttggacaaactgcgcgaatacgtcaaacaagcaggcggcacgcccgtcgtcgccatcggcggtatcgacttgaacaacgcccgagccgtactcgccaccggcgtttcctcactcgccgccgtccgcgccgtaaccgaagcggcaaatcccgaagcggtggttaaagcgtttcaggctttgtgggatggataaaaccgaaagaagaaaattcaattgccgtgtaggcaaaacttagcccgttatcgcaaacatacttaactttaaatgtggcatatcatcaaattccgtcattcccgcgtaagcgggaatccgccttaaaacttgagaaaccatcatttgaaaaacagtttccgaatttcaaaaatggattcccgcccgtgcgggaatgacggcaaccggtcagttgcgtatcaaaaaataaagtaattcggctagatatagtggattaacaaaaatcaggacaaggcgacgaagccgcagacagtacaaatagtacggaaccgattcacttggtgcttcagcaccttagagaatcgttctctttgagctaaggcgaggcaacaccgtactggtttttgttaatccactataaatacagaaacatcgagaaaccatgaacatcatcttaaacggcggacccgccgaacttcacggcacgaccgttgccgacctcatcgcccaaaccgcgccgcaaaagccctttgccgtggcggtcaacaccgttttcgtccccaaaggcgcgtatgcggaaacggttttaaacgaaaacgacaaaatcgatatcgtgcggccggtggtcggcggctaggcggttttgccttttcagacgacccctgtccccaaaacaacgttatggtggattaactttaaatcaggacaaggcgacgaagccgcagacagtacggatagtacggaaccgattcacttagtgcttcagcaccttagagaatcgttttctttgagctaaggcgaggcaacgccgtactggtttttgttaatccactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattgaaaaaggcagcaaaaatgccgtctgaaggcttcagacggcatcgcggtccaaaacggcggcggcctgaaacggacaaaccgccattccccggcatcacggctttgtcggaaaaaatggaaaaaccggccggaaaaccttgccgcccgtcccgatgccgcaaccaacgaaacactcggcctccacggtgtgcaggctgccgcgcaagccctaaatacggcaatagaagaagcgttttgttgttgtttgaatacacttaaaaatacctaaagccgtccgtaagccttcatccgcaacggttttaccgctttcgcatccccgaatccacgctcaaacacccccgaatgacaaccctgtccgcgccaaatcggacggatgttcaaacacgggcaaccttatttccgtcaggcacgaagccctcagctatgcctgccgaccccgatttgtccgacacaatgaaagtttgccgacccgaatcacaaacatcggcggacaggttaatttgtttatttttcatcgtattacaaaaaatctgcatttatttttaaatttttattgataattattattattagcgtataatcaaaaccactcggaagccgtccgttccgaaccattaaacaccatatttccccatcatcactttcacacttggagtcggcatatacgagacatacattccctttttatatatcagatactcaaaaccgaaacgccaaacccaccttcgcggtgggtttggcgtttatcgtccggctttcgcgcctatttgcaagacttgaggttcagtttgccgtatagggacgtgattttacgaatttcgtccgcatcggcggcattcacgccggtaaacaaaaccgtcatacgcgacacgctcaaagaatcgtcctgcctgtcggcttcggcaaagtgttcgacaatatgcgccccgccgaatccggcgccggcaagccggttttgcagggcttgggcgttttcccggctgttgccgacacccaaactcaatgcgccgtcaaacggtatggggttgaaacctttggcagacagctccgccgcctgattttcggcatcggcggaaacgggcaggacgacgcggtaggttttgtcggcaggtttggcttgggcggtgcgtttttcgacgctcctgctggcaacgtgcgaccatttgcccaaaagtcctttgatgcggtggtagtcatcttcgtccatcgtgaggcttgcctgcgcggcgcataaggcatccgccgcgccgttttcgcgttccgcctgcgccttttcggcggcgagtttttcgcggcgggctttttcttcacgctgttttttctctttcagttttttctgttccgcttcttttttcaagcgcaactgctccgcctgttcttcgctcagaatgtcgccctgtttgagcagtgcgcctgtatccgattcagatgccgcctgaacgacaggaccggatgctggaatattccgaacaaccggcatagttggggcaactggttgaacctgcaaattgtttgcggcattctgtgcctccggtattctgccggcctgtttcagtgtcagtttgtaacctaccgtaccgccgaatacggcaatattaatcgcaaccaaaaggataaatagccatttcatctctgtattccttaaatatgttcatattccctgccttcggcggcaatcatgttcaacaacccgtaaatgacgaggttgtccgccacgcgcacggtattttccgccaaaaatgcaggcggcagggcttcggcaacttttgccgcgccgccgccggtaatgatgacatcgacaggcttgcccgccccggttttttctttcaaacgcccgtgcatcatcataaccgagccgcaaaccgcatccatcatgccgctggcgacggcattgcccgttgtggtcgggaaaggataacgcttaccggcgtgccggttgaggttggcggttcggacggcgagcgattctttcatcaggtggaaaccgggcatgatggttcccccgagataatgtccgtcatcggtgagcgcgtcaaccgttaccgccgtgccgcaactgacgacgacgcaggcgttgcggctgaagcggcggctgcccaaggcgttgaaccagcggtcggaaccgtgttcttcggggtggcggtagtggttgcgtatgcccaaagcctgtgcggaagacggcagccactcgatttttcgggcgagctgttcctgcacttgtgcctttttgaattctccgcacacagcgcaaccgacgatgcggacatttccatccgccttttccgcccactccgcgcccaaaggcgacaaatcgcggtacggcgcgctaccgacggttgcgaacgtgccgttttccacccacgcccacttgagccggctgttgccgccgtccaacagcagaaaacgttccgaatcccgccgcttcggcacggaaaccggcctgtcgtcggaccgcaggctgatttcgccgctgacgaccgtctgtttgccctctgccgtttccaagtgcaaaacgccttgtccgtccacgcctttaaccgtgccttcgaacacggtttcgccgtcgcgcaacagcaataccgccttgccgtggtcgcggttggcagcctgatattccgccacaaaaggcgcaaatccgtcccgcgcatattgcaacaacaccgcgtccagttccaccaacagcgtttccagcagcacggcggcatcggcattgccccgccgcgatgccgtctgaaacagcgattgcacggaagcggcattttctacttccttgggcaggacaaaattgatgccgataccgaccacggcaaccgttttgccgcccgtcctgaccgtttcaatcagaatgccgcccaatttgtcgcgtccgacaaccaaatcattgggccacttaatctgcacatccaaacctaaacgcgacaaggcgcgccgacacgccactgccgcaacaggcgacagcgaacccaactcatactgcggccggtcaaacacccagccaaaactgaacatcagacactcgcccaaacggtgcgaccacttccgcccctgccgccccctgcccttactttgcaggtgggtcacgcatatggttttgtgcgccttgtccggcgcaatccgcgccaattccagtatctcgtcgttgctggacgcgcactcgtgcttcaatgccgtctgaaaacccgacctttcccccagctcgcgcaaaccttcggcatcgaaaaccgccaatgggcgcaccagccgccaatagccgtcgtgttggcgcaacagcccgcgtatgtgcgccggcatctgctgccaaaaaccgttgagctgctgcggcttcatatccgccatacgcgccagttgcgagacgtgttgcggcaaaccgtcggcaagctccgccaacacccgccagtgcgaaagcttcaaaaccgtcattttccgccctctgccgcacggatttttgccaaagtcttcgttgtcgaagtctggtgcagaaacggaattgaaaacacctgaccgccgcgcgccaacgtttctgccgcaccgacaatcttatccgcagcccaatcgccgcccttgaccaaaatctcaggtttgaccgcctcaatcaacgccgccggcgtatccccgtcaaaccacgttaccaaatccacactttccaaagcggcggcaacggcggcacggttctccaaaggattaaccgggcggtcaccgcccttgcccagacgccgcaccgaagcatcggtattcaacgccagcaccaacgcgtcccccatcgaacgcgcctgcgccagataagtaacgtgccccctgtggaggatgtcgaaacagccgttggtaaacaccagcgggcgcggcaacaacgccaaacgcgccgccaacgcctcgggcggacagattttcgattcaaaatcagggacagaccaagcgtcaaccatcaaagcctccgacaaaaaccataaaagacagaaaaacccacatgatacagaagcatatgcgaaaggcaaagccggcggcgcggacagtacgcgcaaacgggaaaagacccgtaccgaaaagtacgggcctttatctggggtggctgatggggctcgaacccacgacaaccggaatcacaatccggggctctaccaactgagctacagccaccataaaaacggttttcaatcaaattcttggcacgcccgacaggaatcgaacctgtaacccccgacttagaaggtcggtgctctatccggttgagctacgggcgctcatgccgattcgtgctgattgattggtcggggcggtgggattcgaactcacgaccctctgctcccaaagcagatgcgctaaccgggctgcgctacgccccgacttgaagaagcgaactatacaactcagggaaagatgcgtcaacatttattttcaagacaccaagatgaaaaatatagttttttgatttgaaaaaatatttaatccgtccaaacagccgtattttatttcagggcaaatttattttcggcatcctgctgtaaaaacaaacggaaaatgcgataattttcagcattttctacctgtttaacaaaaggacggatatgtcggcacaactgatcaatggtaaagaagtttcgcaaaaacgcctgcaggcggttgccgaagcggtggcgcaacgccaacagaacaatctgcacacccttgcctggccgtggttttggtcggaggcgaccctgccagcgcggtttatgtccgcaacaagaaaactgcctgccaaaaatgcggcatcaaatcactgtcttacgagctgcccgaatcaacatcgcaggaagaactgctggcactggtcgaccgcctgaatgccgattccgaagtggacggtattctggttcagctaccgctgccgaagcacctcgacagccaggcggttttggaacgtatttcgccggataaggacgtggacggcttccatccttacaatgtcggcaggctggcggtcaaaatgccgctgatgcgcccgtgtacgcccaagggcgtgatgacgcttttggaagcttacggcattgatccgaaggggaaaaaagcggtcgtggtcggcgcgtcgaatatcgtcggccgcccgcaggctttggaactgctgctggcgcgcgcaacggtaacggtctgccacagcgcaaccgaaaatctgacagacgaggttgccggagccgatattttggtggtcggcgtaggcattccgaactttgtcaaaggcgaatggatcaaacctggcgcggtcgttattgatgtgggcatcaaccgtttggacgatggcagcctgtgcggcgacgtggaatttgaaacggcaaaagaacgggcggcgatgattacgcccgttcccggcggcgtgggtccgatgacgattgccacattgatggaaaacaccctgcacgcggcttcactgcacgatgcttgagcggttctgaagataaaaatgccgtctgaaaggctttcagacggcattttgccgtgtccgtttatttgggcagcttgacgacaaccgtatccgccagtatgtcgtaaagcgtgcggcggtcgcgtttgaccataaagagcaggacaaagttggcaaggaatgccagcaggttgatggcgttttctccgttgtcacctactgcaagaccgataacggcggcaataatggcaaccaaaaccgaccatgcgatttcgcgtaccaaaaccgtgccgacaaaaccgggattgcggccgtcggttttcaacacacggattctcatgattttcttacccaatgactgcccgtcccggctcatatagtagatttggatgacggtgtacgccaaaatgcctgccagtcctacccaaaaggaagtcatgcccaaaagcagcccgaatatttcttcgccgctgccaatcctgccttcattcttgatggcgaaagcaatcagtccggcaaacggcaccaacaaaaccaaaaaggtaaacaattggttcagcagcgcggcaagtatccggtcgcctgcaccggcaattccgacttcaatttcctgcccgttgcggttgtcggatgccgcgtcggtgtagtcgtttttttcttccatatccgttcctgataattgttcttaactgaccccgattctaccgccacgacaccgaaaacgccaatacttaaagaaatcccgataaagaactttacattttcccaatacggcgttaaaacgcttcctttacgccatacataattttattaacgatttttcctcaaggagcaacacaatgaaagtaggtttcgtcggctggcgcggtatggtcggttcggttttgatgcagcgtatgaaagaagaaaacgacttcgcccacattcctgaagcgtttttctttaccacttccaacgtcggcggcgcagcccctgatttcggtcaggcggctaaaacattattagatgccaacaatgttgccgaactcgccaaaatggacatcatcgttacctgccaaggcggcgattacaccaaatccgtcttccaagccctgcgcgacagcggctggaacggctactggattgacgcggcgtcctcactgcgcatgaaagacgacgcgattatcgtcctcgaccctgtcaaccgcgatgtcctcgacaacggtctcaaaaacggcgtgaaaaactacattggcggcaactgcaccgtttccctgatgctgatggctttgggcggcctgttccaaaacgatttggtcgaatgggcaaccagcatgacctaccaagccgcttccggcgcgggcgcgaaaaacatgcgcgaactcatcagcggtatgggcgcggttcacgcccaagtggcggacgcgcttgccgatcctgccggctcgattctcgacatcgaccgcaaagtatccgatttcctgcgcagcgaagactatccgaaagccaacttcggcgtaccgctcgccggcagcctgattccgtggattgacgtggatttgggcaacggccagtccaaagaagaatggaaaggcggcgtggaaaccaacaaaatcctcggccgcagcgacaatccaaccgtgattgacggcctgtgcgtccgcgtcggcgcgatgcgctgccacagccaagccatcactctgaagttgaaaaaagacctgcctgtttccgaaatcgaaacgattttggcaggcgcgaatgactgggtgaaagtcatccccaatgaaaaagaagccagcatccacgagctgactcctgccaaagttaccggcacgctgtccgtccctgtcggacgcatccgcaaactgggcatgggcggcgaatacatcagcgcgttcaccgtcggcgaccaacttttgtggggcgctgccgaaccgctgcgccgcgtattgcgtatcgtgttgggcagcctgtgagccctgtttgaatggaaatgccgtctgaagcctgtttcagacggcattttccttgcaaccctgccggataacgccctgccggcactgccgacgtaaaaaataaaggattccatttccggcggtatgcggcagcccgactttatccgaacctgatgcgcctgcacgtcaatgaaaacagcccgattgcggacttcctgctacagccgaaattccgataaggcaagcgttcacgccagcaacatttcctgcatcagcttcataccccactgccagccgccgagcatgccgttcaaactgcccgaatgcggggaaaccaacaggcgggcgttccacaaatccgcctgtttttgcgcccaaccgtgcggcacgccgccgtgttcgggtacaaccaatgcggcacggcagggacagcggacgcgttggaaagcgtgttccgcatcgtcgggaaaaatatcgggacgctgcggtacaaggatgatgttggcaattttcttccgtgtcaggatgtctgcctgatacagccacgccaaaaatgcggccgcgcccgcaccgtgtgcgacaacggcgacgtatttgccgcgtatgcgttcaaatgccgtctgaagccctgcctgccattcccctatgctttgaccggccgacgcttcggacatctgcacgacgggataactgatcgcccaacggtctatccacatctgatcctctccggcatcgcgtatcagccaaagcgtcaaatcttcgagttcaaaaccctgcataccgccccgcctatttcagcaggtcccggagggtaaaggcgatgagcagcgaagcgggtacgctcaatatggcgcagacggtcaggcaggcaaaaatattcaccacccgccgccagcctttccaacccaaacatttggacgcaatcagcaggcagggcaggcaaatcagcagccacaccaacgcccatatcgggtttgccttggtcggcgcaagccagccttgcatccgcgacaacataaatatcgcccacaccaacatgggcaggataaacgcagcgacgacccatgccgcgcctattcctgtttttccgtccacattccaatcatatttacccaaaaccttattcggcagcatagtcatactccacgaccagcggcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcccggcacatcgggataaagcgtgcgccacatatccgtccaaccgagcttgtggataaccttgcctatccactcgcgctcttcaggcaggaaacctgaatttttctggttgcctttccagtttttcaggtcgatgttttggtgggcgatgttccagtcgccgcagacgacaatgtcgcgcccttcgtttttcatcgcttcgagcatagggtaaaacgcatcaaggaaacggtatttcacctgctggcgttcttccgcgctgctgccgctgggcaaataaagcgagataacgctcaacctgccgaaatcgcaacgcacaaaccgcccttccctgtcgaattcttcaatgcccataccgatttgcacattgtcgggtttgcgtttgctgtacaccgccacgccgctgtaaccgcgcttctcggcgcaatgccaatgaccgtgcatcccgtgcggatttttcatatcggcagacaaatcagcctcctgcgctttgagttcctgcacgcagacaatgtccgcgcccgatgcggcgatgtattcgtaaaaaccttttttgtaggcggagcggatgccgttgacgttggcggaaatgattttaagcataataaaaataagttctcacaataaaaatgccgtctgaacaaaaaagggcaaaatgcggcacatttacccttttcgatggattttaaccgcgccgccaagtcgtgccgccggcgttgtcttccaaaatgattttgtgttcgttcagaaggtcgcggatgcggtcggattccgcccagtttttatcggcgcgcgcctgtttccgccgggcgatcaagtcttcgatttcttcgttggagagaccgtctgaagccgcgccgccttgcaggaactcggtcggatcgcgttgcagcagtccgatgatgccgcccaaggctttcagacggcctgccagttgcgcgtcattggttttgttcacttcgccggcaagttcgaacaacaccgccaccgctttcaccgtatcaaaatcatcattcatcgcaacataaaagcggcgcgtgtagtcatcgccggcttcagacggcatcggatcggcgggcggcgtatttttcaaagtcgtatacaaacgcgtcaacgcgccttttgcatcatccaaatgcgcgtcggaatagttcaacgggctgcggtagtgggcgcgcaggatgaagaagcgcacgacttccggatcgtattgtttcaacacttcgcggatggtgaagaagttgcccagcgatttggacatcttttcgccgtccacgcggataaagccgttgtgcagccagtatttgacgtggctggcgatgctttgcccgtggtgggtttgcgcgtgatgatgaccgcaggtatgccccgtcgcgccgacgctttgggcaatttcgttttcgtggtgcggaaactgcaaatccgcgccgccgccgtggatgtcgaaggtatcgccgaacaggttttcactcatggcagagcattcaatgtgccaacccggacggccgttgccccacgggctttcccacgccggttcgcctgctttggcggctttccacaacacaaaatcaagcggatcgcgtttgaaaccgtccacttccacgcgttcgcccgcacgcaggtcgtccaacgatttgcccgacaattgtccgtaagcggcaaactcgcgcacggcgtagtaaacgtcgccatttgcggcaggatatgccttgccgttttgaatcagggtttcaatcatggcaatcatttgcggaatgttttccgttgccttcggctcaatatccggacgcaacacgcccaaagcatcggcatcttcgtgcatggcttggatgaaacgcgcagtcagtttgccgatggtctcgccgttttcagccgcgcgggcaatgattttatcgtcgatgtcggtgatgttgcgtacataagtgagcggatagccgcactcgcgcaaccaacgggcaatcatgtcgaacaccaccatcacgcgggcgtgtcccaaatggcagtaatcgtaaacggtcataccgcagacgtacatacgcacgttttcagggtcgatgggggaaaagggttctttttgacgggttagggtgttgtagatggtggtcatgggattatggattaatctttgttgctcggatgataatttctgttctgttcctgtagatacggaccaaggaacattacgtagttgcggattattaatatggctgatatttgtgaaaattggttctgcataacagtttgcaaaattttttgtaaattctgataatttaaacttatcttttaataagtttgctaaatctgatgacgagggataaagtttacttcttatactaggcatttcaatatgaaggactatttttatttcgttacaatctaaagccaagcgagaaaaatctttttcttcctgtttttctgctttaaatttagcagaaaccaatcctgccaatgaatctcgaatttttcttgcgattaaatatggtaggtcagaaagtttttcatctattgattgggcatttggctcaagcccaagtcggtaataatctttaatttcgattagccaaagtgtcgattcatgaagggctattatatctacacctgagctgccattatcgtcatctacactttgatttatcccgttctttcccttttcatttgtatcaattttattacgtaaattacaactgttctgaaaaattttataatgttcccattcgtcatacttggtaacgtaataatcttcaggaaaagcaaaggttaatctcttttctgtgattgtagtcatagcttaacctcaaatattcagatacctgtctgcctgcataatgttttcatctaacaatatcaatgtgttcaaatcattaatactgttcccttgctccacttttgttccatcatcggaagcaatcaacgagaaaaaacgtacaggtaaatccgtgttattttcaagcttcaaaagttccaattctctcaataagaataaagagtgtgttgcaataaaaacctgaataccctgttgagataaagaccaaataatacgggcagccactttgatcaatttaggattcagattagcttccggttcatcccaaaatagatagcctttatccagcaatgcccctgttgcgattaaccgggcaatcatgacaaatttccgcaaaccctctgctaccaaaggtgcttcaatcttaccgcccgtatttgtcagcgatagataaaaccttccttgttcttcagatacttttccgcccatcgcgttctcaataggttcgagcaattctcgaatttttgtttctctggggcctttggcaagcgggtgatttaattgcatacaggtatcaaaccaagtttcttcgaaagggatgctttggttttgatacaaagaagtgaaccaagggcaaagtgtaattaattcgcggctgggtaagaagataggtgtcggagtatattcattttctttcaatccgatgctttgaacattgacttgcgatgatgagttactggaaaaattcagactactatgcgtagtgccgttttgcagttttaaaacgatttccgtacgcccgcgcccctgcaaacgtttgctcaacctacccaaggaatcgggacggaaaacattcagtaatttatcggcaaaacttttttgcaattctgttttcagtaatctgtttttggtgttagatgttacttctagcaggctgtataaaatttttaacaaatgtgttttgccacaaccgttttcggcaacaataacattgagattttcagaaaattcaaaagtatcgtttggaagaacggtaaagtttgtcaactcaagcgactggatatattggttagatgacatttttaatccatttcaatcttgctttaaaattgtttcaaacaaccttttgtagaacaaatatcgtctgaaaccctttcttttttcactccggcttaaacacgcctgtatccgttttaggctgctgttcgataatttcaacatttgccgctgctttctccgcttctgctttttcagcttcgatacgttttttctcggtcaggtattggttgatttggtgtaccaattcctgcgtgccttggtgggtcagcgcactgatttggaagaggcgcggggtttccatgtcaaattggaaacggtcgtcgggtttggggtagtcccagccgacggcttcgaggaaggcggcagtgcgcgtttgggcttcttcttcgtcaagcatatcgagtttgttcagtaccagccagcgcggtttgccgtagagttcttcgtcgtatttgcgtaattcgttgatgatggcgagtgcttcttcggcggggttgacggtttcgtcgaagggcgccaaatcgacgacgtgcagcagcaggccggtacgtgataagtgtttgaggaaacgatggccgaggcctgcgccttctgccgcgccttcaatcaggccggggatgtcggccatcacgaagctgtggttttcgtcgatgcgtaccacgcctaagtttggatgcagggtggtgaaggggtagttggcgattttggggcgtgcggcggatacggcggtaatcagggtggatttgccggcgttgggcatacccaataagccgacatcggcgaggactttaagttcgagttgcagggaacgggcttcgccttcttcgccgggggtggattgtttcggggcgcggttgacggacgatttgaagtggatgttgcccaagccgcctttgccgcctttggcgaggcagacgcgctgtccgtgataagtgaggtcggcaacggtttcgccggtgtcgaggtcgcggataagggtgccgacgggcattttgaggacgatgtcgtccgcacctgcgccgtaacggtcggaaccgtggcctttttcgccgtttttggcttggtagcgtttaacgaagcggtattcgacgagggtgttggtgttttcgtcggcttctgcccagacgctgccgcctttgccgccgtcgccgccgtccgggccgccgcgcggtacgaatttttcgcggcggaaactggttgcgccattaccgcctttgcctgcggcgacttcgatttttgcttcgtcgatgaatttcattcaatgctcttgtttgttggtttcaaatggggggttcagacggattaccgtgtgttttgatgccgtccgaacagaatttcggacgctattataagggataagcggtatttcaacacgccgtacccaaactatttgttccgcccatcttaatgaatttttaagcaaatcttcagcctgcaaacaaaattatgtccaacttctttggtacaatcgcgcctttttgacattccgacccgacggaatgtccgttcaaaccgttacatataataagttttttatgaacacaaaccaacctgccgtttacgacccgttgacacgcgcgctgcactggctgaccgttgccggcttcatcggcattctgaccaccattgtcctgtggacgatttatagtggattaacaaaaatcaggacaaggcgacgaagccgcagacagtacaaatagtacggcaaggcgaggcaacgccgtactggtttttgttaatccactatacgaagaggcggaatgggtgggcagcctgttcggcctgcacaaatctttcggtttccttacgctgacggtgattacattgcgcatcgtgtgggcggttgccaaccgcgccaagcgtccgcaaagcgactgcaaggctgcggcggcaggccacggcattctgtatctgctcatgcttgctgttcccgttatcggcatgatccgccaatacggcagcggccgcggcccgttgaaagtgttcggcgttgaagtgatgcaagggttcgccggaaaaaatcgagtggatggcaaacttgggcaacacgttccacggcaatttgggcttgctgctgtttgccgccgtcgccggacacgtcgccatggtcgtcgcccaccgtgttcagggtagagatgttctgtgccgcatgacgggtcgtgtccgctgattccgttcacactatggtgccggctcgtccggcactatttgtttttccaagacagagccagatcgtacaaagctttctttccctcgcccgtgattttggcagcaagctccgccgcctgtttggtcggcagctcggctgtgaggattttcatgatgttttgcgcggactcggacaagccttcgtgtttttcatcctgcgccggataaagcaccaacaccatctcgccgcgcgattggttgccgtcggcagacaatgccgtctgaatttccccaaccgtgccgcttaagaacgtttcaaacgttttcgtaatttcgcgcgccagcattaatcggcgttcggggaacagttccgccatatcggcaagcgtcgcaccgatgcggtgcggcgtttcaaacatgacgataggaaacgccgcccgcacccatttggcaaacagtttcctgcgttctcccgatttcggcggtacaaaaccgttgaaataaaaatcggatccttccacaccggccacgctcaaagccgccatcaccgcgcttgcgcccacgacgggaacgactttaaacccggcctcacgcacgcggcgggcgagtttcgcgcccgggtcgcacacggccggcgtacccgcatcggaaacctgtgccacaaccatgccgtctgaaagatagccgacaatcttgtccgccatctgccgttcgttgtgttcgcgcacactgacgagtttgccctgaatgccgtacgcgctcaaaagctgtgcggtaacgcgcgtgtcttcggcacagatgatgtccgccttttgcaataccgccaaagcgcgcagggtaatgtccgccaaattgccgatgggcgtggcaaccacgtataatgtccctccgacgacgctgtcggaggctttctgcaaatgtttctgaaacataagaatgccgtctgaaaaacaaacattataaaggttaaaccgattatgcgcctaaaccacaaacagggcgaggcaggggaagatgccgcgcttgccttcctccaatcccaaggctgcacgctgcttgcccgcaactggcactgcgcctacggcgaaatcgacctgattgtcaaaaacggcggcatgattctgtttgttgaagtaaaataccgcaaaaatcggcaattcggcggtgtcgcatacagcatttccccatccaaattattgaaactgcaacgaagtgtagagtattatctgcaacagaacaggttgacaaacgtaccgtgccgcctcgatgcggtacttatcgaaggcagccgcccgcccgagtggatacagaatattacaggttgacgatatgacgacattacaagaacgcgttgccgcccattttgccgaaagcatccgtgccaagcaggaagccggaaaagtattggtcgagccgaccgtacaggctgccgagctgatgctgcaatgcctgatgaatgacggcaaaatcctggcctgcggcaacggcggttcggctgccgacgcgcaacacttcgccgccgaaatgaccggccgttttgaaaaagaacgcatggaactcgccgctgtcgcgctgacaacagacacttccgcgctgacagccatcggcaacgactacggtttcgaccacgtattcagcaaacaggtgcgcgcgctcggacgtgcaggcgatgtattggtcggcatttccacctccggcaattccgccaacgtcatcgaagccgtcaaagccgcacacgaacgcgatatgcacgtcatcgccttgaccggccgcgacggcggcaaaatcgccgccatactcaaagacaccgacgttttgctcaacgttccccatccgcgcaccgcccgtattcaagaaaaccacatcctgctgatacacgccatgtgcgactgtatcgactccgtactgctggaaggaatgtaacccttttcagacggcatggcgcaaagcaatgccgtctgaaacgcccaagaaaggaagcacccgatgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctgactcggcaatgccgtctgaaccgccttcagacggcattgcccgacaccccaaaagcacaatcaaaatggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaacctcttctgacccggcacggcaggcacacccgcaatccaaggaagcattatgaacggcatcatcatcaaaacccccgaagaaatcgaaaaaatgcgcgagctgggcaaactcgtcgccgaagccctcgactacatcggacaattcgtcaaacccggcgtaaccaccgacgaaatcgacaaactcgtttacgactaccacgtcaacgtccaaggcggctatcccgcccccctgcactacggcaacccgccctaccccaaatcctgctgcacctccgtcaaccacgtcatctgccacggcattcccgacgacaagccgctcaaagaaggcgacattatcaacatcgacctcaccatcaaaaaagacggcttccacggcgactccagccgtatgtttaccgtcggcaaagtctcccccatcgcccaacgcctgatcgacgtaacccacgcctccatgatggcgggcatagaagccgtcaaacccggcgcgacactgggcgacgtaggttacgcctgccaacaggttgccgaaaacgccggctattccgtcgtacaggaattctgcggacacggcatcgggcgcggtttccacgaagccccgcaagtgttgcactacggaaaaaaaggacagggccccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtgaccgaaaccggctacgaaatcctcaccgtcagccccgcctccggcaaaccctgaaaccggacgtatccgccccataaaaacaaacaatgccgtctgaaagaaacggcagatatgatatataatataaaaacaggcttgacccggcacattacgaaaacaaagcaaatcggaatttgccccgcaaccagacaaacttaaaggaagttttatgaaaatatttgaaaatatagaagatgttaaagccatccgtaaaaagaccgggctgaaccagatagacttctggggcaaggtcggcgttacccagtccggaggatcgcgctacgaaaccggccgcaaaatgcccaaacccgtacgcgaactgctccgcctcgtccatatcgaatgcatcgatttggcgaaagtcaacaaaaaagatatggaaatcgccgccctgttgaaaaaacaccatcccgacctgtatgccgagttgtccaaacagaccaagtccgaaagaaaaaaacaaagttaaaccgcaacctccggatgcccgacagtttttcatttccgaaaaacgcaaacaatgccgtctgaaacaccggacaggtcgccgtatcccgcctgccgcccctgcctcaaaccgccgaaccgcccgaacccgcctttttacaaactttatccaatttcctgtttatttcgggatacgccgacattagaatgtcaaacagctcgaaacgggcaaactccacatccatccaaaggaataaaaatgaaacttctgaccaccgcaatcctgtcttccgcaatcgcgctcagcagtatggctgccgccgctggcacggacaaccccactgttgcaaaaaaaaccgtcagctacgtctgccagcaaggtaaaaaagtcaaagtaacctacggcttcaacaaacagggtctgaccacatacgcttccgccgtcatcaacggcaaacgcgtgcaaatgcctgtcaatttggacaaatccgacaatgtggaaacattctacggcaaagaaggcggttatgttttgggtaccggcgtgatggatggcaaatcctaccgcaaacagcccattatgattaccgcacctgacaaccaaatcgtcttcaaagactgttccccacgttaatcaggcaacaaaaaacagcgttttcagaaatgaaaacgctgtttttttgaccgttccattattcacaaaagggaaaaaacgattacctgccccgtgtatcaaaacctgccctgccggatgaagggcataaccggcagggacggcgtcaacaccatatgggggtacggcttttcttgaaagattcggcttaaatatccaatactttcgcggtataggcgataatttcatccgccctttcagggttttcgttcaacttgatgccgtaacccggtaccagctctttcagacggtcttcccaagacggggcgcgctcggggaagcattggtgcatcagccggatcatcagcggcacagcggtcgatgcgcccggcgacgcgcccagcaatgcggcgagtgagccgtcggcgtgggcgacaatctccgtaccaaactggagcacgccgcctttttcggagtcttttttaatgatttggacgcgttgccctgcggtgatgagttcccagtcgtcggggtttgcctcggggtagtattccagcagggaggcgaagcgttcttctttggttttacgcaattcgcccagcaggtatttggtcagcggcatattcgcccagccggcgcacagcataggatagaggttgtccatatggatggacagcggcaaatccataagcgagccttgcttgaggaagttggaacggaagcctgcgtaagggccgaacataaggtggcgtttgccgtccacgttgcgtgtgtcgaggtgcgggacggacatcggcggcgcgccgacggaagcctgcccgtacactttggcgttgtgttgttcggcggtttcggggttgctgttgcggaagaacaggccggacacggggaagccgccgtagcctttgccttcggggatgccggatttttgcagcagggtcagcgcgccgccgcccgcgccgaggaagaggaagcgggtacggagggtgagctgcccgtcggggttgcgggtatcggcggttttgagcacccacgcgccgtcggattcgcgtttgatgtcttcgacgtggcggttgaactcggtttttacgcccttgccctgcaaatatttcaccatttggcgcgtcagccgtccgaaatcgacatccgtaccttcggcggagtagttggcggcgacgggttggttttcgtcccggccgcgcatcatcagcggagcccaatcggaaattttgttccgatcggtggaaaattccatattttcaaaaagtttttgggttttaaacgcgtcataacgtttttgaagataagaacaatggtcttcattcatcaccaaagacatatgcggcacggcattgatgaaggaattgtcttccaacttgccttccgcgaccagcgtcgcccaaaactggcggctgacatgaaactgttcggcaatattgagggcgcgcgccggatcgataatcccatttgcacccaacggcgcatagttcaattcgcacagcgcggaatgccccgtgccggcgttgttccacgcgtttgacgattccaacgccacatcttccaagcgttcaatcagggtgatttcccaagacggttcgagttctttgagcaaaacgcccaaagtcgcgctcataatgccgccgcccaccaagacaacgtctgtcgcttcagccatggtttactcctaaaaaacaggcatcttctgcccttatggttatttgccgtactacaaacgcctgaatcgcaaaagcagggaaaaccggcaatggtgtgtgtccgagtatgctgtttcggggttggaatgcgttgcaagcatggcttccgacaccgcttcaggggcttgtaatatgttatcgtgaatgtagtggattttactgggaaatgcaaagtttttctgtcgcccgccaagtcgggaaactgcgaaatgaaaaataaaaatagttatttatctatatatatcaaatttttaatagataaaaaatcaaaattgtttatatattaatttttaaaagattgtcagcatattgcgttaagttttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaatttgaaaatactgcctcacacctgcacgccataccctgccaacctgccggtcaggatttccctgtttttgcaccaatcttccctcagcatactgtacacgaccgtatcgcgcacactgccgtctttacggagcatatgcatacgcagcacgccgtctttttccgcacccagccgttcgatggcacgttgcgaggcaaggttcagaatatccgtgcgccatcccacgcaacggcaagccaaaacatcaaatgcggaatccaacagcatgattttgcaacaggtgtttatccgtgtccgccgtgccgatgccgcataccatgtgaatccgatatccaaacgcggaatctgcggttcaaaatgataatacgccgttgtcccgaccaccctgcccgcctcttcatcgacaaccgcaaacgccaaacgcgttgccaatgctgtcccgatatagtctgccaccctatccggatggggcgcggacgttacccccagcttccaaacctccccatcgcaaaccgcctcgcgcaaacccgtttcatgatgcacatccaacggttcgagacgaacgccgcccaacgacaagaccggcagtattatcttttccgacatccttttctcccaatattccgccttcagacggcatttccgcccggaatgccgtctgaacggctaaaaacacaatatccccgcctccgacacaaaaccgtccaaagaccggtcgtgcgcctcgaccggcagcctgtccaccaactggcaggcaaagcccacgcccacggtttttgcctgcaaacggtatttcatcgctgaaagcgtcgcatcgtaatagccgcctgcctgtcccaagcggtagcccagcctgtccataccgaccactggcacaagcaggaggttcaaatcatgcacacgctttttccgacctgcaaactgagggacatgcagcttcgccctaccgcgcttgcgttcttgttttactccatcggcaggatacggcgtaaaccacatccgccgcgaacgcggttcgatataaggcaggtagagttccgcaccgcgtttttgcgccgcgcggacaaagccgtccaaacgcaattccttgcccatcggccaatacacgccgattttccgcccttttttaatataacgtttgagcaggtggttgatttttaccgttgccgccgcccgcacgtcccgccccatttgcgaacgccgcccgcgcaattcgcggcgcagggcgcgtttttcctcgttcctcatttcagacggcctttcaggattgcggtagaatgttgcgattataacgattttgttaacattcaaacaggacgcacacaatgtggcacatcgtcgccatcggctatctttttgttgccgttatgtattccgccgcgcagccgagtattgcgcgcgccttgatttatttggttttttgggcggtgctgcccaccgtgttcacggttttcaccattaccgtccgccgccgcaaccacctgatgaggcagcaggaacaggcggaatccgaacagcagcgcgcacaacggcaaaaagacagcggcacaaaaccctgaatcccttttcagacggcatcttatccgctataatccgtcagttttccatttcggaaacacactattttttaaaacttatgcccactttcgccgaagggtgcttgacaataggcgtgacctatcaagttctatgcgattgaatgtgtgctcttaaccctttcaaggaaataaaatgtctcaaattactatgcgtcagatgattgaagccggtgttcacttcggccaccaaacccgtttctggaacccgaaaatggcacaatacattttcggtgcgcgcaacaaaatccatatcgtcaacctggaaaaaaccctgccgatgttccaagacgcgcaagaagccgtacgtcgtctggttgccaacaaaggtacagtattgttcgtaggtaccaaacgccaagcccgcgacatcatccgcgaagaagcgacccgcgccggtatgcctttcgtcgattaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgatgttgaaaaactggaacgttctttgggcggtatcaaaaacatgaaaggcctgcctgacgcgattttcgttatcgataccggctaccaaaaaggtactctggttgaagctgaaaaattgggcatccctgttatcgccgtagtcgataccaacaacagccccgacggcgtgaaatacgttatccccggcaacgacgactccgccaaagccatccgcctgtactgccgcggcatcgctgacgcagttttggaaggcaaaaaccaagcgctgcaagaaaccgtagccgctgcccaagaagccgctgccgagtaatccggcaaaccgaagaggggcgttatgccccttttctcaaatatgccgtctgaacgtccgttcgcggcacacgattcccgaatgcggaaaatcctttccgtatttcccaaaaatctaggagattcaaaatggcagaaattactgcaaaaatggttgccgacctgcgcgccgctaccggcctgggcatgatggaatgcaaaaaagccttggttgaagccgaaggcaacttcgacaaagccgaagaaatcctgcgtatcaaatccggtgcgaaagccggtaaactggccggccgtaccgctgccgaaggcgtattggcttacgcgatcaacggcaatgtcggcgcattggtcgaagtaaactgcgaaaccgacttcgttgctaaagacgcgggcttcgtagaatttgccaacttcgttgcgaaaactgctgccgagaaaaaaccggcttctgttgaagaactgagcgaactggttgaagcagaacgcaaagccatcatcgccaaattgggcgagaatatgtctgtccgtcgcttccaagtgatcgacactgccaaccaactggttgcctacatccacggcgcattggcgaccgaaggcgtattggttgagtacaaaggctctgaagacgtagcacgcaaaatcggtatgcatattgttgccgctaaaccacaatgcgtaagcgaagccgaagtagatgccgaaaccgttgaaaaagaacgccacatctacaccgagcaagccatcgcttccggcaaacctgccgacatcgccgctaaaatggttgaaggccgcatccgtaaattcttggctgaaatcactctgaacggccaagcattcgtgatgaaccccgatcaaactgttgcccaattctctaaagaaaacggcactgaagtgatcagcttcgtacgctacaaagtaggcgatggtattgagaaaaaagccgtcgattacgcagccgaagttgctgccgctgctaaagtgtaaggcacttatgaaaaagaaagcacctggattccaaacgaatcagggtgcttttttttgagaaaaccgtttacggtacctattttaagacgaccgaatattcagaccgtcttaaaacaaaacaataataaaccgacacaccctatcattaatattccgaccgttggaaattcagacggcccaactccgaccgacgacattcaagaaagcaaggtatccatgacacagcaaatcaaatacaaacgcgtattactgaaactctccggcgaatccctgatgggttccgatccgttcggcatcaatcacgataccatcgttcaaactgtcggcgaaattgccgaagtcgttaaaatgggcgtgcaagtcggtattgttgtcggcggcggcaatattttccggggcgtatccgcccaagcaggcagcatggatcgcgccaccgccgactacatgggcatgatggcgaccgtgatgaacgcgttggcactcaaagacgcatttgaaactttaggcatcaaagcgcgcgtacaatccgcactgtctatgcagcaaatcgctgaaacctacgcccgccccaaagccatccaatatttggaagaaggcaaagtcgtgatttttgccgccggtaccggtaacccgttcttcacgaccgacactgccgccgcattgcgcggtgcggaaatgaactgcgacgtgatgctcaaagccaccaacgtcgacggtgtgtacaccgcagacccgaaaaaagacccgtccgccacgcgctacgaaaccattacttttgacgaagccttgttgaaaaacctcaaagtcatggacgcgaccgctttcgccctctgccgcgaacgcaagctcaatattgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggattaaatttaaaccagtacggcgttgcctcgccttgccgtactggtttaaatttaatccactatatttacaattttgatacaatttgtttttcatcaaaggagaaaatctatgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttgattcacactaccataaccgcttgctaccaaggaaaacaaaatgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaagaatgaaaaaacagtaatttttcatttttgaaactaatctaatttttagcagccgtaggtcggattctcgaatccgatattttccaacagcggcatttcggaaacgatagatgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcatcaattccgccagacaatgggctgatgcccatccgaatataacagcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgatttataggaaaaagccatgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaacttaacaacccaaatttttgtcagagcctagtgcaaattacaactatgattctattgtagccgaaatgaaagaaaaaaatcatgggttggcgacagggttgatgttgttaatatgcctgatggagcacctactagtatggataacacgcgtattatggcagcacgtgaagcaggagtaaaagtggaagcgaatgttcataattttaatgaccgattatcatcaaaagagagaatcaggtttaagcatgatggtattgagcctcaaacttggggagaagctatccagctacgaattagaaagcaagaaacacaaaaaggagttccagaagggtggagcaaaagatttcctaacggaagtatttatgatgtaaaggtacttaggaaatgataaaacaaaatagttttgttccgtatcctgaagcaatgcttcctaaaggatttaaatatccgcaaagttatttaaaattagctcaatccactcatgccattaactacgatgaacaatattcttttccttggtggtttgaaaatgcagaaagcaatatatcagaagtaattgacatttattttgaaataactggcattccaaacctattaccttttgctagaaaccaagagtgggctgcctgttttgatatttcagataaatcaggtaatcctaaaattatagtagttaatttagataatacaaaatattacgagacttttgaaaattttgatacttggctaaaagaagctgaaaatgatggttggtagcaaccgtaggtcggattctcgaatccgacatttttcaacagcggcatttcggaaacgatagacgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcattaattccgccagacaatgggctgatgcccatccgaatataactgcaacagcccaaactgccctttccgtagcagaagccgcaactacggtttggggcggtaaaaaagtaaaccttaacccgaccaaatgggattgggttaaaaataccggctataaaacacctgctgcccgccctatgcagactttagatggggagatggcaggtgggaataagccaccaaaaccaagtacgcagcaacaccctacacactctgataacaatatcggcttacctgcctcatatgttaaacctgatacatctatttctccgacaggaacaattcaagaccgcatcagatggacaaagtccaagtttcctactgagaaatctttaaatggacatttcaaagctcatggaaaagaatttggcgatataaccattgaagactaccaaaaaatggcgtctgatttgttatcaaaacagacatcggacaagatattaggttatcagacggaacatagacgagtgcgctatgatatcaataacaatatctatgttttggccaatccaaaaacattcaaaatcaaaacaatgtttaaaccaaacttaggaaagaagtattatgatggagaattcaaaaaagacatgggaaattgacggagaaatatggctacattgtcctgtttgcggaactgaagttatggactatgatatctgtgacgtttgtcagtggcaaaatacaggagaaactaatatagatggtggccctaatgaaatgacacttgcggaggcgaaagaagcttacgcaaaaggcttaccaatcagataaataagcacctagagaaatcaatgatgacggaatcccatggttacctatcaaataatttacctgttaaaatcataaatgatattatttatgcaacccagttagtcgaagatttggttttaggaaaaataaaaattgttgattttttaaaatcatataacaatttttattgttggcttggttttgatgagttgcctcaatctgagaaaataaaattcctaagctatcttaatatattaagtattcataaagaaatacaagatgaaactgtgaatagggtttataccgattgaaaaatagtagatagagattaacatgttaaatgaaatttttgaaatttattcgagacaaggggaatctttgataggaattggaattagagaagccgcattacccgtccctattgcaatagatatattaaatttatttatcaatgagagaatacttgtattggggggagatatttatatcaagaaagataattatttttatcaaacatatgataattggtattacgagggaagtaatttatttaacagtatcgacaaagcaatgcattatttatctcaaataaaattagagaatgcatacgtatcttttgtgttgaaatttatctaacaaaggaagcacaagaatagatttatagtaaaacatcaagatgttgaaaatgctgggttttaatccaacctacactgaccggctcagatacagccgctcagcagactctacaaggtattaatgatttaggaaatttaagtccggaagcacaacttgctgccgcgagcctattacaggacagtgcttttgcggtaaaaaacggcattaattccgccagacaatgggctgatgcccatccgaatataactgcaacagcccaaactgccctttccgtagcagaggccgcaggtacggtttggcgcggtaaaaaagtagaacttaacccgactaaatgggattgggttaaaaataccggctataaaaaacctgctgcccgccctatgcagactgtagacggggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttagcaaaagacggttgggttaagcgtgttcaaaacgtaaacaaaattgaaatacattacattgaaaactcaagaaccggtgagaaaacagattttaagtttaaggattagtcatgtttttagatgatgtaaatgtttttttagatgatttaaatgtttttttagatgatttaaatactaatccaatcactgacgaatggtatatgtccaattttgccgataaacatattaaaattttggaaagttacgaagcctttgatattctaaaacaatttgttgattacatgattgaagaatatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttagataaactatcaatatagaaggaaatccttggaaaaaataaaatgataatcgaacacaatggaaatatacataaaatagccagaatgactggaaataaaaataattttttagaaataatcctatcagatattcatgaaaacataaaaatcaaaccattaactataaaagtaaaaggagagaatgttataaatatccttcctgaggaagttagtttttatgtaaaacaaggtgttgatttaatttatgaaaaatataaacggaaattctttatctccgaaatttctttttgccaatcagatagccggccttcaagtatctacgcttttcttacatttcacttgcttgaagatattattaaaaatgaatccccatccaactacacctgactggctaatagcaggtatgaaccgtgtattcatatcaatataagattaattacggcagaatttgatgaaattagacaaaaacttatcgtaagattttatttagacagagaagtaactgatgatggcaaagaagatatggaaacagcacgaacagaattacttccaggaggatatgcttcatctctggtagtttgacagatttgaccgcttcataaacttagaacattaattaatgatgataatgtttatatgattggttctaaggatagcaaaagcaaattcagaaggaacatgaatggctatttatgacttaaacgaaatagccgtaggtcggattctcgaatccgacattttccaacagcggcatttcggaaacgatagatgcgtcaaatatttttgtcggatacaaatatccgacctacatctctgcgcagcaaactttacaaggtattaatgatttaggaaatttaagtccgaaagcacaacttgctgccgcaagcgcattataggacagtacttttgcggtaaaagacggtatcaattccgccagacaatgggctgatgcccatccgaatataactgcaacagcccaaactgcccttgccgtagcagaggccgcaggtacggtttggagaggtaaaaaagtagaacttaacccgaccaaataggattgggttaaaaataacggctataaaacacctgctgcccgccctatgcagacgttggacggtgagatggcaggaggaaacaagccagttgttaaatctatcagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaatgaaaaaaaatatttttcacaatgtaagcctttatgaaataatcttttccgataatggaaatacccttacattatcttttacagatacaattgaaggtaattatttcggatatatcaaatgcagtaatattttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaatagtaactgctttcccagcagccgtagcaactgtatttttacccgacggggtaaaaatacagttgctacatctctgcgcagcagactctacaaggtattaataattcaggaaaattaagcccggaagcacaacttgctgccgcgagcatattacaggacagtgcttttgcggtaaaagacggcatcaattccgccagacaatgggctgatgcccatccgaatataacagcaacagcccaaactgcccttgccgtagcagaggccgcaggtacggtttggagaggtaaaaaagtagaacttaacccgaccaaatgggattgggttaaaaataccggctataaaaaacctgctgttcgccatatgcagactaaggcgttaggtacggtagatgaaattggcgatacagtacagcaggttgggaaacaggctagcggacaaaaaaccagcggtggtaatcctgcgattgatagcgacccctatagcccgagtagtgtggcagctcgcatagaagccggtaaggcgcgcagtgatttacaaatcaaagacattttgagcaatactactcaaaggagtaaaacaaaaggtcccgctgttcagtatgataaagtgggggattacaatgacgcactaaatgattttaatagtctgaatgttcgaaatgtacaaacacgtcctaatggaacgataacgggcaatttacctgatgggcgtgcggttaatgctcgtaatgatagtagtggtggagaaccaacacttgaaataacaattagtaataaccgaaaaataaaaatcagatatggaaatacacgataaattatgaaattaaaaagcttagatttcccaactggctatttctattttgataatgcagcaataaactctgataaagtagaagttatagcagttggttatagaaatacggataaaaccataaaaatttttattgaagatgttattcattttagggttgttgatgaatcgtattttatagatacttttatggatttaatttcggaagatgcagatagagctttgcttcatgaaaatggtggtcaatctttttttgaacttcttgatgagtgttatgcggaatggatattgaaagaaagttattttcctttgaatagagaattctttaaatactatatttttatgtttgagcaaacattcatagaaataattggttctagtgcaacgtattcaattattgagggctagcgtaagatgagtaataagttgcctatctttctttcaggcagcctgaaaataaaactacccaagttgatggtgtacctgtatcagtgaagggaaattttgttgatggtaaatttcgcattggtacggcaacaatgaaatcattttaaattgagctagaaatgaacctagaaaattatgaaaacattttaataaaattacttttttatcataacaacttagtaaatgaatattcttattttattgaaaataaaaatttatttaaaatagtatctcgaacgaaaacgagtaagggcttttttttcactatagaaaaaccattaaattttctaagcaaaaaaacttattttgagtttaattttaaatatttacactcagggaaagaacgctttggttcgtttatgtgctggataaatactaatttaatggaatttgagggggttttttttaacgacctgctccctgataatatgataataaataacttttttgaaataaatgattaacgatacaccaataaaaattggtggggtaaccgtatggatgatattcgcggcatcatccaaggtgcggttaatcctttaatttacaaggtaagcaagcaaaagattatttacaacaacaaactcatatcaggaacttagacaaatgaatgaacacaacctgttaattttctgtttaaaagacaatgtttcaattagtgaatatactgaaatgattgattgggcttataaaaacattcaatctgaaacagttgtagaaattacggaaaatcaaattattgaatatcaaaatcgtggattatggagacttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttttgagactaatccaatttttagtaatattgatgcagagcaagcagcattagatgccgcaaacatggggagaagctattcaatttagaattaaaaaacaaattgaaaatgaactagcaccaccaaattggtctacccagtttcctaatggtagtatttatgatcctaaggtaacgaaatgattattcaaaatgaatttaatttatatcctagtaatatgcttcctgaaaggttttgttatcctgaaaagtatgttcgtatctctaacgatacatctttaataccttatattcagccacataattttcactggtggtttgagaattatggaacagaaggggcagaagtagcttatatatttagaaattctatcctgcctgatttaaatcttatcccattcgctagtaatggagaatgggaagcttattttgatggtaatgatgtaacaggaaattctagggttattgtcattaatttagataatatagaaaaccatgaattttttaatagttttgaagattggcttgaattagcaattaaggatacttggtaagcagctatctataaagagatgaggctgccctggacaactaggataaactcgattttactaattgttttaaaatggaacaagaacttttatttcactgttgttaaaacgccattcgcactcctttaaatacagctcaaaatgcgctttgggaatgccgttaaacttgcgtaaatgacgttttgcttgattccaaaagttctcagttccattaatatggttttgtcgttcggcaaaatgtgtgctgtgattgatacggaaatggctaaattcgcccgcatccaatacatcatagccacgataacaaaatgagtttattttgtttataccgtcttagacgactttctctcatagggataattctaacttaatttgaatttccctagtgatctagggcagcccctaaattaataaagcagcacaactccttttgccgatgttccggactgtcaaacgactgttcctcatgccacatctccatcaaggtacggataacccgctccgccttaccgttggtctgcggacaagcaaatcgggcaagcctccaaccaatcccattatcataacaagctgcaccgaaagcatgttggacggctctttatattacctatcattgtcagagtaaacgtactcaatcaggtacaagcaggggtcggacagatgttcggtcagaaacttggcagcactgtctgcggttttgtccggcaaaatggcagagtataaaaatcgtcaatagcgacaaacaggtaatctcgtttatcagcggccttctgtcctttgagcaacaacaaccgatcggtatcaggatgcacaaaacctcccggggacaacctgccttttacggctttaagtgcacggtaaatagtgacgcggctgacttagtggcagcatactggggaggtgagtgtttttgtgtatatttttattttggtattcccttagaaatactgtaaacaacgctaccggacggcctgcagggcttcgcgcacgcttgctttgagttctgcgccgaagcgtctgcccaagattctgccgaaatcgtccttcggagtgtaatccaccacatcgggggctttgaccacgtctcgcgccacgctgtaaatattgccgagtccgtccaccagcccgactttcagcgcatccgcgcctgtgtacacgcgaccgctgaacacgtcgggatattgtcggaatttgaggcggccgccgcgtccggttttgacggctttgatgaactcgccgtgtatgccggtcagcatttcttcccagatttttgactgttcgggcgtttcgggcgaaaacggatcgcccatgcctttgttgctgcctgcaattttaaccctgcgtttcacgccgattttttccatcaggccggtcgcgtcgaaactgctgccgataacgccgatgctgccgacgatgctggacgggtcggcatagattttgtccgccgccgccgcgatgtagtagcagccggacgcgcacatatcttccgccacgagataaacgggaatgccggggtgctgcgccttcagacggcgtatttcttcaaaagcggtgttggacacgacgggcgaaccgccggggctgttggcgcggatgacgatggcttttgcctgcgggtttttgtaggcggcctccataccgtctttgagttttttgacctggtcttctacaccgttgccgatttcgccgtacagattgacgactgcggtatgcggcgtgttgcccgccaactgcaatgcggcttcgtcttttcggaaaatgcctgcaatcagggcaaccagaatcagggtgctgacggcgcgccagatgtttttccacatccgctccctgcgcctgtcctgataggcggacaacagcacttcgcgcatgatgtcgcgctcccataaggtttcccccgcattttttgcttcgggtgcttcgttttctcttctgattcggtattgcatggttttccttaaatattgtccgatttgggcaaacggttttcagtttacccgatttttcagctctgctcccaatccgtccaagctgtgcaacacttccgcccacgccgcgtccaaaaggttgacggcttctccttcggctttgatgccgaactcaatgtgcggtttgacctgcgtgccgtctgaatgcgtccaaccgacgctgggcaggctgtacgaacgcacgccgggataagtttgctcgatatgctccataagcggcgtaatgcgcgattcgggctgctcaaacacatacacgctgcggctgccgcgttcggtttggttgaagcggtcggcgtaataagtttccaatacccattccgccatcgggtgcgccatcacaggaaagccggggaagaaataatgctcgcggatagaaaatccggcgatgttgttaaacggattgggcaccaattccgcgccttcgggaaaatctgccattttcaggcgttgggcgtgttccggcgaatcaagcggctcgccgcgtttctgggttatgccttcgataaacttggcggcttcagaatggcggacgacgggcaaatccaaagcagcggctgcggcttggcgggtgtggtcgtcgggcgtggcgccgataccgccggtaacgaaagttggcatgccgtctgaaaagctgcggcgcagttgcctgaccagcaaatcgggttcgtcgggcaggtattgcacctgattgagcttcagccctttggattcgagcagggatttgaaaaaggcgaaatgcttgtcttggctgctgccgtgtaagatttcgtcgccgatgatgatgaggttgaacgcgttcatagatggtttctttaccgatgccgtctgaaaatgtcgatggtgctgtgatttgttccctctcccgtgggagagggttagggagagggtcgagcttgcgtttttcaggcagcgtttgcttaaggcctgctgtctgtaccctctccccaaccctcccccgcaggggagggagtcaggttgaggatggcgtaaagaccgtctgaaaagattttcagcgaaacgggcaaagcttcttttcagacagccttaacggctgacaatgggttatatttataagataatgaactccttttttcaagtccgaaggatacccttatgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataaggtttgctgttttacatcattagcaacttaaggggtcgtctgaaaagatgatcccttatgttaaaaggaatcctatgaaagaatacaaagtcatcatttatcaggaaagcctgttgtccagcctgtttttcggcgcggcaaaggtcaaccccatcaaattcagcgagttcctcaataaacaaacccccgaaggctggcgggttgtaacgatggaaaaagatttgcgccgtatgctgctgtttttcaaacgcgaggcctacgtcgtcattttggagcgggatcgtgtttaagctcggcgtttatacctgtctcggactgtttgccggctgggtgctgctgctgatcgtgcaactctggttttcttttctcgaagcggaattgttcttcaaaatcacactgactatggcggggctgtttgtcatcatcctcgccgccttactggtatgcggtcagtatttttccgaaaagaaaatgaaagacgacgggtttatcaactgatgcggacttgaaccggacccgcgacccaaacatcacaatgccgtctgaacgccctcgcttcagacggcatcaacatcaatcctgctcttttttgccggcaaacacgccgaatccgcccttttccgcatctgtcgggcgatagctgtattttcccgccacttcctcgccggccgggccgtaaaactttccggaaacatccccgctgccattttccgtccaagtccccttaaagccgtttccatcgatggcggctttgaatttttgcgtacccatatgcaaatcatcgccgctgtcgataatgccgtccacagatttgctgccgaaatcgacttttgcggcaaacctgcccctggtcgggtacggacggccgttttccgtatggaaatgcagtacttcgccgttgtacacggccgcgcccgcaagcatttcgccttttgccggttcgccttgaacacgaagggcatacgatccgccgggcaatttttccgccccgtaagtcagataccggtaattcccttcgggcgcgaagatattgccggaatgccccgtcaggctgaccgcttccccatcgacaatcagcgtatccgcctgattgacgggaatcagcggcatctcggccggaagcgaccgcctcgaccgtgcagaacgcctaaatcgcgcaaatgaagtgggtttaggtttataaaagataatatattgattgattcccttcatctgcacactatcggcaaccaaaccgacaaatttatcattcttcccatctttcttgtaattacttattttgtctgcatcacttaatttttcaaattctgattttagctgtacttcttcatccaagaaattattgccactacaagaatcgcctttacagtgggtcaacgttatattttgcgacggcccgtcaatcaaaacgccattagccaaatcaacccttccaaaattgctaccgccattcgcaggtgcagggtttgacgcggggatgggatctgaagaaccggcggcttgattgtttccggcttgatttgcaccttgggcagccgtattgccggcattttgcccgcctgccgacggatcgtccccctgcattccgtccgccgcatttgccatatccggttggtttgccggctgagacgattccccggcatccgttgcttgattttccatatttccggcaagcatattcggatccggggtgtgattcggtgtcgaactatctgtaccggcggcattttgcggcatatcattttgtgccacctcgtcttcatttttgggattatccgctgttaccgcaccgccattgcctgtattttcttccgaaaccgccgccatatcttgactgccttgtgcggatggcgcgccctgtccttgagaacctgcctgtggcgcatcttcctttgcctctgtctctttttcagaaacaacaggggcggcaggttttgacagcgtgtccgccgacttgacatcgggcgatccgccaccgccgcccccgcaggctgaaagggcaaaaatacaagccattgcgattacgctgcgtttaaacatcatcatctccttcatcgtatttcctttttggtttaaaccccgccacttggacatccgtccttcggggcggtggaatcagctttatttgggaagagcgcaacctttccaaatcagggcgacacatagggctgtgctttatgtgccgccctgtgtgttgaaacatattcaataaatattgtttccgccgtatgcctataaaattgtaaaaatatgccgtctgaacgccaaacgggcttcagacggcatagcttggtttattccgcccggttcctctgtcggcccaaatcggcggcagcggtaaacaaaacgtcggtcgaagagttcagcgcagtttccgccgaatcctgaatcacgccgataatgaagccgacggcaaccacctgcatggccacatcgttatcgataccgaacaggctgcacgccaaaggaatcagcagcaacgagccaccggccacaccggatgcaccgcacgcgctaacggtagccaccaggctcagcagcagggcagtggcgaagtcaaccgtaatgccttgcgtgtgcgccgcagccatcgccaaaacggtaatggtgattgccgcaccggccatattgatggttgcacccaatggaatggagatggagtaagtgtcttcgtgcaaacccagctttttcgccaatgccatgttcacagggatattggcggcggaagaacgggtaaagaaggcataaacgccactttcacgcaggcaggtaaacaccagcgggaaagggttgcggcggattttccaccacacgatggcgggattgaccgccagcgcgataaacgccatacagcccaacagcactgcaagcagcttcgcgtaccccgccagcgcgccgaaacccgtctccgcgattgtggacgacaccagcccgaaaatgcccaaaggggcaaaacggataatccatttcacgacggtggaaaccgcttccgccaaatcggcaacgacctgccgcgtaacgtccgaaccgtgattccgcaacgccgcgcccaaaaccaaagcccaagccaaaatgccgatatagttggcattggcaatcgcgttaatcgggttggcgaccaggttcatcagcagcgatttcaatacttccacaatgccggaaggcggcgcggcggacacatcgcccgcgcccgccaaaacaatgtgcgtcgggaaaaccataccggcgatgacggcggtcagggctgcggaaaacgtaccgatgaggtaaaggacgataatcggcctgatatgcgccttgttgcctttttggtgctgcgcgattgtggccgccaccaaaataaataccaaaaccggcgcgaccgctttgagcgcaccgacaaacaggctgccgaacaagcctgccgccaagcccagttgcggggaaaccgaaccgattacgatgcccaacgccaaaccggcggcaatctgcctgaccaggctgacgcggccgatcgcatgaaataaggatttgccgaacgccataattcttccttatgttgtgatatgttaaaaaatgttgtattttaaaagaaaactcattctctgtgtttttttttattttccggctgtattttatagtggattaacaaaaatcaggacaaggcgacgaagccgcagacagtacaaacagtacggaaccgattcacttggtgcttcagcaccttagagaatcgttctctttgagctaaggcgaggcaacgccgtactggtttttgttaatccactataaggttgcgttgatttgccctatgcagtagtgccggacaggctttgctttatcattcggcgcgacggtttaatttattgaacgaaaataaatttatttaatcctgcctattttccgacactattccgaaacgcagcctgttttccatatgcggattagaaacaaaataccttaaaacaagcagatacatttccggcgggccgcaacctccgaaataccggcggcagtatgccgtctgaagcgtcccgccccgtccgaacagtgttaaaatcgaaagccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaaaccgatatggccacttcagacggcattgcagcaaaccattttgaaacagacattatgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataagcggttttcagacggcgcgccgccaaaccggacatttgaaaacctgcttttccaccgtccgccgccgccgtccgcctgcaagggaacagaatcgatatagtgaattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcgaaagcgggaatctaggacgcagggttaagaaaacctacatcccgtcattcccgcgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcaaaagcgggaatctagaatctcggactttcagataatctttgaatattgctgttgttctaaggtctagattcccgcctgcgcgggaatgacgattcataagtttcccgaaattccaacataaccgaaacctgacagtaaccgtagcaactgaaccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagccgcagacagtacaaatagtacggaaccgattcactcggtgcttcagcaccttagagaatcgttctctttgagctaaggcgaggcaacgccgtactggtttttgttaatcctctataatgcgcccttcggcgtggcggatatataaggaagtgattttccatctaagtaaaaaccgccctatcggataagcccttaacagaaaaggctttacccgcgccgtatcggaacacatcctctaaaatacaatccgttgaattgaaaaaaatataaaaacatccgcccgcgaaaaacggcagcgcgtcgtttgacaaagaatgaaaatatcggttaaaaaccgattttcatacaaaaaacaccgctgccgtccgcatccgtttcagacggtattgagagaaaatcttttaggagaacctttatgtcccggcatcccgcccccaccggagaaaaaacattcttcggccaccccttccagctttccaccctcttccatatcgaattgtgggaacgtttttcattttacggaatgcagggcatcctgctgatttacctctactacaccgccgacaaaggcggcttgggcatagacaaaaccctcgccggcggcattgtcggcgcatacagcggcagcgtgtacctgtccaccattttgggggcgtggtttgccgaccgagtatggggtgcggaaaaaaccctcttcctctcgggcatcgtcgtgatgctcggacacatcgtccttgccgccgccccgggcctgtacggccttttaatcgggctgatattcatcgcattgggcagcggcggcgtgaaatctacggccagttctatggtgggcgcattatacgaacaggacgaaatgcgcccgctgcgcgatgcgggattttccattttctacatcgccatcaacatcggcggcttcctaggcccgctgctgaccggcctactgcaggaaaacatcggtttccattatggtttcggcgcggcggcggtcggtatggcattcggcttgtggcgttattccctgggacgtaaaaacctgccccaccccaccgtcccccatccgctttcaaaaggacagggcaaaactgcggccgccgtcggcatcgccctcatcgccgcacttgcaaccgccatcaaaaccgggcttgtcaacctcgacaatttctccggcatcctattatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttaccgtgcccgtcgcttggaaagattctatgcaaagcctgtgggtcatcctgttttccggactgatggcggcaatgtggacaaaaatggggcgcaaacagcccaaaaccccgctgaaattcgctatggcggtatttgttaccggcgcgtcgtttttgggattcgtcccctttatttcctccggtacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctatcggctgctgttctacatcggcgcagccacaggcttcctgctgctcctgctcgtccccaaattgaacaaaatgctcgaaggcacagactaagtcccgccccgatgccgtctgaacccttcagacggcatttttccgcataatgaaaccaaaccgtttccacccgacaggacaggctcccgcccaaccggaaggcagcctgccgattgtcatttgaataacgcaagggaaagccgttgatttccgtttgtatggaaacagtttggtttcattggaaaaaggcattttgtccgactaaattagtgctgcatcaacgaaatatatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgttaatccactataaaaacacaacctaaataaaaatgccgtctgaaccatatttcaggtttcagacgacatttgcgtgtcggatgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtgaggaatccaaaacatacgaacggatttggctgccccaacctacatcggatttaccttcttccaacgcctgtttctcttcattgcgtttgcgcatttccaattcatacagtttggacttcaacatttccatcgcagcggctttgttggcgtgttgcgaacggtcgttttgacattgcaccacaatccccgtcggctcgtgggtaatgcgcacggcggagtcggttttattgatgtgctgaccgcccgcacccgatgcgcgataggtgtcgatgcgcaaatcggcggggttgatttcgatttcgatggaatcgtcgatttcagggtaaacgaacacggaggcaaacgaggtatggcgtttgttgttcgagtcaaacggcgagtaacgcaccaagcggtgaacgccggtttcggtacgcagcaaaccataagcgtattcgccttccacacggatggtggcgcggttgatgcctgcgatttcgccgtcgtcttcttcaaggatttcgattctgaagcctttgcgctcggcgtagcggctgtacatacggaacagcatacccgcccagtcttccgcttccgtaccgcccgcgcctgcggtgatgtcgataaagcagttgttcgggtcggcgggctggttgaacatccgtttgaactccaaatccgccatctgtttttccagccccgctacgtcttcctgcacggcggcaaaaccttcttcgtcgttttcttcgacggtcatttcaatcagcatgcggttgtcttcgatgcccgaagcgatgttgtcgagcgtcaacacgatgccttcgaggattttgcgctctttgccgatttcttgggcgcgtttcgggtcgttccaaagttcggggtcttcggaaagaccgataacttcttccaatcggtctttcttaccctgataatccatataaactcggatgtcttcgctgcgcttttccaaatcgttcagggtattgttgagctggttgattacttcggcttccatgattcttttgttctttcaaaattttaggggcgtattgtacgggattcgggtatttttttctatggataaagccttctggaaacacgttcagacggcatagcgtcaataacggtatgccgccagtttgcgtttgatttcaggcaatgcggcacgtgctgcctcctcacccaaccggatggcgcgttttttctgatcgaatccgccgactgcacccaaatccaaaacctgcggtttgataaccacatccgcctgccccaactcattttgcaacgcagaaacgctcattacgttcagcgtctgatcgagataagagaagaaaccttggctgatgtttttgcccggacgggcggaaatatcgacggcaatcacgaaattcgccccctgccgccgggcggcactgacgggcacgggctgcgacagaccgccgtcaacatatgtatgcctgccgatgataacgggttggaacacattgggaatggcggcggaagcgcgcacagcctgcccggcattcccctgattgaaagcgacggccttgccggtttcaaaatcagtagcaacggcggcaaatttgatgggaaactgctgaatctgcctgccgccgacttttcggttgatgtaattttgcagcttttcgcctttgataaaaccactggtggacaaggttaaatcgaccaaatcggttttgcctaaaatttcggcttccaattcgaggcggtcgggcgacatacccgatgcaaaaaggctgccgacaatcgaacctgccgatgtgccggtaaccaccttcacaggaataccgttttctttcaaaaccttaataatacctacatgggcaaatcctttagatgcgccgccaccgagtgccaaaccgaccactgcggcgggtttggcggtttgcaccggcttgcggacagcattatttcccgccgtgccgcaggcggcaagcaacgcggcggcggcgattgccaaaagcggtctgatttttgaaaacgttaccatattttccattcctttatatatcgcaccccgtcaaaaagagggattgcttttcttaacacccccctttgacagccaagcaaatgggggctttgttaagtcatcatcaaaattaatatttcttttttttttcctttacggaaattatatttgaaggcatactatccaaggcgggaattatctcacaacaccgccgttatccaaatatcccgcctttttccctttctttccatcaaaatactttctttttatattcattaacttgttaaatcattggctgccgggtgtcagtttttccgacaaaatccgtctaatggggtatcaacagaaccaaaacaggaacacttatgaaaatcggaacaacttggcagacggcatccgctatgctggttttgcgtctgtttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtattgttgcttttgggtttggcaacgcgtctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaacggttttgcccccgatgccgtctgaaacaagattgattcagtcgtggaatctgactttaaacattccaaccttatctcgttaacttgatattttgaaaaggaaatgacatgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataatcccaccccttcaaaccaagccgcgtttttcagtaaaatgcggcttttttaacggcaaacaaagattttttaacaagcacatcattcttttgtgccatccgaaccgggtaaaaatatgattcaacacgcaggcttgggctaccgccgcgacttggcggaagactttctctcgctttccgaaaacagcccgatatgctttatcgaagccgcaccggaaaactggctgaaaatgggcggctgggcgcgcaaacagtttgaccgtgtggcggaacggctgccgctggcgttgcacggattgtctatgtcgctgggcgggcaagcaccgctggatactgatttgatagacggcatcaaagaaatgatgcgccgttacgattgcacgtttttctccgaccatttgagctactgccacgacggcggtcatctttacgatttgttgccgctgccctttaccgaggaaatggtgcatcatacggcgcggcgtatccgcgaagtgcaagaccgtttgggctgccgcatcgccgtggaaaacacgtcctactatctgcattccccgcttgccgagatgaacgaggtcgagttcctcaacgccgtcgcacgtgaggccgattgcggcattcatctggatgtgaacaatatctacgtcaacgccgtcaatcacggtctgctgtcgccggaggcttttttggaaaatgtggatgcagagcgcgtgtgctatatccatattgccggacatgacgtggaaacgccggaattgttgattgatacacatggcgcggcagttttgccgactgtttgggacttgctcgaacttgcctatgccaagctgccgacgattccgcccaccctgttggaacgcgattttaatttcccgcctttttccgaactcgaagccgaagtcgccaaaatcgccgattatcaaacgcgtgccggaaaggaatgccgccgtgcagcctgaaacctccgcccaataccagcaccgtttcgcccaagccatacgcgggggcgaagccgcagacggtctgccgcaagaccgactgaacgtctatatccgcctgatacgcaacaatatctacagctttatcgaccgttgttataccgaaacgctgcaatactttgaccgcgaagaatggggccgtctgaaagaaggtttcgtccgcgacgcgtgcgcccaaacgccctattttcaagaaatccccggcgagttcctccaatattgccaaagcctgccgcttttagacggcattttggcactgatggattttgaatatacccaattgctggcagaagttgctcaaattccggatattcccgacattcattattcaaatgacagcaaatacacaccttcccctgcggcctttatccggcaatatcgatatgatgttaccgatgatttgcatgaagcggaaacagccttgttaatatggcgaaacgccgaagatgatgtgatgtaccaaacattggacggcttcgatatgatgctgctagaaataatggggttctccgcgctttcgtttgacaccctcgcccaaacccttgtcgaatttatgcctgaggacgataattggaaaaatattttgcttgggaaatggtcaggctggactgaacaaaggattatcatcccctccttgtccgccatatccgaaaatatggaagacaattccccgggccaaaaccatctatccgcataaaattaccttgttcccgatactatgccgctacccgacctgaccgatgccgaattaatagagtcgcgtaaactgcttctgcattttgcgcggcttcagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcggaaggcagaggaaagtctttaccacactggatgacgagctactggatgaagcatttgaaagccatttttcccaaaacgggcattggacgcaggaagggcagccgcaacattggaacactccggaaaaatcattaaacaacaacgaattccaaaaaattctgcaaagctgcctatacaacctgcctgaaaacaccgcacgggtatttaccctgaaggaaatactcggtttttcatccgacgaaatacaacaaatgtgcggtatcagcacgtccaactaccacaccattatgcaccgcgcccgagaatcattgcgccaatgcctgcaaatcaaatggttcaaccaagaaaacccgaagtaaacgttatgaaaaaatgccgcgatatcgccctgcttctttccaaacatcaggaccgggaaaccaccccgggcgagaagatttccatatacacacacctgctgttctgtccgtattgccgtgaatataaaagacaacttcaaaccatcaaaagatcactggcaaaaacaaccagaacttcaaaataaatgccgtctgaaaaggcttcagacggcataagctgacggaaacaaatcaaaccgatttactgttatctgcagttcatccataatacacacttcaaaagcagcatatttccccatacggaatgtataaatacgcaaaatacgaaggctgcatcaatttgccatatttgctttatttgccttatttcacagacggcgctacccctcccgcccaacccgttctttctgaatgagcagatttcaatgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctgattgcaacttatacacaaacttacccacaaaccttatcataaaaatgccgtctgaaatactgaaatatcagcatttcagacggcattttgccattccctgaaaattatccacaaagttatccacattattttttaaaaccggcttccatccgaaatatagtggattaacaaaaatcaggacaaggcgacgaagccgcagacagtacaaatagtacggcaaggcgaggcaacgccgtactggtttaaatttaatccactatataaactcgctatacaatttcactatccaaacgtaaattgttccattgatacacaaaactgcttacccccataattttgataaagcatttcttacattcccggctccgtcccgtaaccaacacagcggcggattcgcatttgaagtgcaactttccctaacagaaaaaggccagtatgcggtagcatacgacctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagagcctctaaaaaataatcgcttgttttgacaccgatacactcatatagtggattaacaaaaatcaggacaaggcgacgaagccgcagacagtacaaatagtacggcaaggcgaggcaacgccgtactggtttaaatttaatccactatacaaatacagaaactcaagaaaataaccttgtgtattgaccatctcaagcaattcagaaaaatcaagaaattttctgaccgtaaacaaacgtttccctaaaaaaacgatgtcttcaaaaatatcgaacaaatagagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaaataatcatcttcggcgttttcatttttatggattaaaacaacacgggaaaaatctgttttcagatgcttgcccgcttgattgttcggattattgtccggaacgacaaaaccgtcctcaaaattaaagcagacgttgcgtccttctacctttatctctgtgcaataacaatcatgtagagaaatgctatccgaaaaattttttctttgtgtatgcaaaaaaagttttcattcaagtacccatatctaacgcaaacgtttacctgtttccccgtcaataatctgactcggcgatttctgcctgccgattctcccaccaacaatccacacatcgcgtccgaattgccttctgacttccctctccgtccgacacgcgcgtttgcctgcgcggttgcacgaagtcgagaccaaaggcgtttgcaaagcctgacacaagcggcgcgcacctacatgggcgggaaccctgaccgccaacttgctgcgctgtttcccgcgtaactcgggtaagacacaggatttggcggataataggaacgttttaggggcgggccattcttttctaagcatatcctgaagattttcagacggcatttgaagtaaaggctgcaattgttcaaattgattcccgatgacaatcatacccttgtgttgcggtctttttttcaaatgcgccaacttaccgagtgctttggctaatgtcggaagacaccccaagccataacaagattcggtcggataagcgaccaaaccaccttttttcaaataaacgcttaacttacgttgcgctgatgctgcgataattctcggaaataacataatataaaataccgtctgaagcacattagtcatacttggcttcagacggcatcatcctctttctaattaacggttaatcgctttatcggcaatgtctttacggtattgcatcccgtcgaaactgattttttccaacgcgccatatgccttagctttcgcttgcgccacattatcgcccaatcccacaacacacaatacgcgtccgccgttggtcaatacgtcacctttctcgtttgccgttgtacctgcatggaaaactttgccgatttggttggcagcatccagaccggaaataatatcgccttttttgggcgtttcggggtaattttgcgccgccagtaccacgcccacggcagtttgcgggctccattccgcggttacgctatcgagtttgccgtctattgccgcttcaaccaaatccgataagtcgctgttcagtcggctcataatcggctgggtttcaggatcgccgaaacggcagttaaactcaatcgtatagggtgcaccgctttgatcaatcatcaaacctgcgtacaggaaaccggtgaactcatgcccctccgctttcatccctgctacggtcggcaaaataatttcattcatcgcgcgttcgtacacaacaggcgttaccacaggcgcagggctgtacgcacccataccgcccgtattcagacctttgtcgccgtctaaaagacgcttgtggtcttggctggttgccataggcagtacattattgccatcaaccatgacgataaaactcgcttcttcgccttgcaggaaatcttcaattacaacacgcgcgccggcattgcccattttgttgtccagcagcatatcatcaatcgcagcatgcgcttcatccaaagtcatcgccacaatcacgcctttacctgccgccaaaccatcggctttgataacgataggcgcacctttctgattgacgtaatcatgtgcggcatcggcgttttcaaaggtttgatattgcgcggtcggaatattgtatttcgccataaatgctttggcgaaatctttggaactttccaactgcgccgcatattgtgtcggaccgaatatttttagtcctgcagcacggaaatcatccacaatacctgccgccaaaggcgcttcagggccgacgacggtaaaaacaatattttctttacgacagaattcaatcaaatcctgatgcgcagtcaagtcgatgttttgcaacttgggttcaatcgctgtaccggcattaccaggcgcaacaaatactgtttccactttaggcgactgcgccaatttccaagccagcgcgtgttcgcgaccgccattaccgataaccagcagtttcataccatctccttgacaaatatgtacttttaacgaaaactcgatacaaagggacttttatcccatctgaagaaattttagtagaatcaaacaaaagaccgcttcattccactctgcaacctattcaacttatccataaattaaaaaaggacaagcaaccatgcaaaaacgtattgatgaaatccaaagcaaataccgcgaatggtgtcatttactaccgcaactggaagaagacatccgccgttggaaacatgtcgtcactttaattcgcgacatggacaatttctatacccacgagtatcaggcgtgtcatcaggctattgaagacggggtagaactggatttgagtacggaaggcgaatacagcattatgagtgaagatgcgctatggaacgcgctgggcgaattccatcaattggcttggttatatttgcgctccagcgtcgatgccttagacaaatatacacaagaagattagtcagcgaagaggtcgtctgaaataccatcacaaagcatttcagacgacctttcattcaaaaggcttttccgtatttacttcaatctgccgagtattcttccaagccgcaacacaggcctcataatttaccaacgacaaactgaccgtcaatcggcaatccaactgcaaatcccgctccaatatatccgcctgatattgtttggcaatgcgtatcgcttcattcaaaaacggatattcacatttcagccaaacagttttttcaatattcttttcaactacttctgcaactgccaacgcttgagccgtcgcctctttgtacgcatgtatcagacctggaacacctaacaaagtaccaccgaaatagcggacgaccacaaccaaaacgtcggtaatacccaccgaatcaatctgtcccaaaattggtcgtccagcacttcctgatggctctccatcatcgttggcacgaaattgcacaccatccacacccaaacgataggcatagcaccagtgtcgtgctttatgatgctcttcctttaacggatcgaggtattttttcacatcagccaatgtccgaatcggataggcaaatgcaataaaacggctgcctttatctttaaactcagcctgcgtcaaggaagtaatggttttataagtcgtaatcatgctgaaatgttttcagacgacctcattaataacaaggtcgtctgaaagtttcacgtgaaacatcaatttttcaatacttctgttaattgtggaacgatttcaaataaatcgccaaccaatccgtaatcggctacattgaaaatcggcgcatcagcatctttattgattgcaacaatcaccttactgtcttgcataccggcaacgtgttgaattgcacctgaaataccgattgcaaaatagagttgcggcgcaaccactttaccggtttgtccgacttgagcatcgtttggcgcatattcggcatcaactgctgcacgggatgcaccgattgccgcacctaaaacatccgccaacggtgtcagcacttcattgaatttttccgcactacccaacgcacgaccaccggaaacaatcacttttgcctgagtcagttcaggacgatcggaatgggaaagctgacggttaacaaaacgactcaggttttgggcaggggttgcttcaacattaattacctcagcattaccaccttgcgccgccactgcgtcaaaaaccgtcgcacggaaggtcagcaccaatttttctgaatcagcttgcacggtttcaaatgcattacccgcataaatggggcgcacaaaagtcgtgttatccacaatttcggtcaaatcagaaatttgcggtacgtctaataaggctgctacgcggggcaaaaggtttttaccgaatgtggttgccgttgctgcaacatagcggtaatcggccgccaatttaacaaccagcggagccaactcttcagccaaaccttcggcataatgagcagcatctgcaaccaaaacttttttcacccccgctacttgcttcgcgaattccactacagcagatgcgccgtttccggcaaccaataaatcgactttgcccagtttggcggcagcggtaacagcatgcaaagtggtaggattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccataatattggggagtttgacaaagcgcggctcgttcaaacgcaaatccgcgctgataacagcaggcagtttcaatgcgatggtttcttcgccgccatcgatttcccgcacaatctgcacttcgtcgccttcaatttgtactttggacgcgaacgtaccttgcgccgcattcagcaaagctgccagcatttgcgccacttgattggcatcatcatcaatcgcttgtttgcccaaaaagaaaatttgcggattttctttgtccgcaacggctttcagcaacttagcaacggccagagactccagtttagtatcggtttcaacatgaatggcacggtcggcacccatcgccaaagctgtacgcaaggtttcttcgcattttttctcacccaaagaaaccgctacgatttcgcttacttttccggcttctttcaaacggacagcttcttccacagcgatttcgtcaaacggattcatcgacattttgacattgccgatatccacatccgaaccatcggcttttacacgaactttgacgttgtagtccactacgcgctttactgcgaccagtgctttcattgaaccctcctaaaaagaacgctgctttcaccatccagcgaaaccaaaccttcttccctataaaaccaaatccgttttccttaaaaacgaattcattcaaaaatctttcggataatgcttgccgattataccatttttaaagcatttactcagactagcggatatacattcctgtatctaataaattggaaaatatcatgccgccatatcagttttagacgaccctttagcctttatctgctgcaacacaatccatcagcgcttgataaaccaaatctgcggtcggaatctgcccgatattgcccaaattttttgcaattggcgaaacctgaacgcctgttttaatcggatcggtatcggtataaatgccgaccacaggtttttccaaggcatttgccaaatgcagcaaaccggtatccacgccgacaattccgaccgcgtatttcagcagatacgctgcctgcaataaatttattttgtcgcacacaatagcaaacggcagcccatctgcaatttgtttggcacgcgttttttcatcttcatttccccaaggcaggtaaatattgcattgctgttcttcattcaacttttgcagcaacgaccgccagttttccacaggccataacttactgtcccgactggtcgcatgcaaagccgcataatacggctgcgctaaatttttcagacggcctgcttcaggaacagtcaagccaaatacctgcgtttccggcattacatacccaaatacttgggcaaacagttcacggttgcgccaaacggcattttttcccttcggtacagcgtatgtttttacatacgccaaagcagcccatccctcgcgcgcactgtttttatccaaaccacaaatcggggattttgccattttagcgaaacacgcgcttttaatcagaccttgactgtccaatacgaaatcaaatacttcctgccgcaaagtctgtttcagatgacccatttcccgccaagtttcagcccgaaagagatgtttgcgccattgccgccatttcatcacatggattttttttacaaacggatgcaggcgcgcaatatctgcaaatccagcctcacatagccaatgcagttctacatcaggacattgtcgcgccaaatcttcgattgcgggcaaagtgtgaattaaatcgcccatactagacaagcggacaagcaaaattttcatatttaggaagggggtttcacgtgaaacaattttaacttattgattattaatatatttatttatttcatcagcgttttttaagatgattgccccagcagaatgcatttcctgccatgctgtttcgatggtttccggcgcaataccccgacaagccgcttcattgacgacaacctgccaacgaccgcctttgagtaactgcaaaaccgttgttttaacacaataatccgtagctaacccaccgataataaccgtatccgtattttgacaacgcagccattcaatcagccctgtgcttagtttttcctcaatatcgtgaaaacacgcgccgtaaggatgcaattcaggatcaacacctttccaaacgcaataatcgtattctttagcagaaggcagcccgtccaataattcatagccgcgcgtaccgaccatcgcatgagccacccaagtcaaatccgcatcaggcaaacctgtcggcttcaacatatcaacagggttatccacaagccatttcgctaccatatgatgcgcatctttcgtcatcacgcgcaaatccgccaaagcggcttgcgcattcaactcctcgacaatcaaatgcccctcgttcacgggcagttcgtcaggacacagtggcgtaaacgttttttgtgcatcaacatcaatggaaacaatcatctcattatttcaacgcgattaaaatgccctgtattataacaaattactgcccaaaagcggtaaaaccgattgtgataagataaggtttttccaaaaaacttatccacaaccttatgacttataccattacccccatcggcaccgcccgctcgccctacaaacagaaattcggcatcgcccgccagcccggtttggtctccgccgcaaaagcctgcatcgagctgaatcccaaattcaccgcagacagcgtgcgcgggctggaagatttcgattatgtgtggataagttttatttttcacggcgtattggatgaaggctgggcgcaaatggtgcgcccgccacggctcggcggcaaacaaaaaatgggcgtgttcgccacgcgcagcccccaccgccccaaccatctcggactctcgctcctgaaactcgaacgcatcgaaaccggcaaacccgtccgcctctattgcagcggcgcagacctgctggacggcacaccgattgtggacatcaaaccttatatcccctttgtcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcagattacgaagtcagatttcaaatcgaggaaaaccgtgcaaccgttattgatctttccccaaccccgctttaaatcgggcaaaaatccggttttgccgcatagcagttgaacaaacggctgttgtttgttcgccataagccgcaatatcaagttatagcggattaaatttaaatcaggacaaggcaacgaagccgcagacagtacaaatagtacggcaaggcgagataacgccgtactggtttaaatttaatccactatacagataaacaatgccgtctgaacgcaatgtgttcagacggcatttacttatccacaggtttgttcaagccttagattttgcctgcgaagtattccaaagtgcggacgagttggcaggtgtaggacatttcgttgtcgtaccaggcaacggttttcaccaattgtttgccgcccacggtcatcacgcgggtttgggtcgcatcgaagagcgagccgtattcgatgccgacaacgtcggaagaaacgatttgatcttcgttgtagccgtaagattcgctggcggcggctttcatcgcggcgttgatttcttctttggttacagggcgttcgaggatggaaaccaattcggtcagcgagccgctggcaacagggacgcgttgggcggagccgtcgagtttgccgttcaattcggggataaccagaccgatggccttggcggcaccggtgctgttgggcacgatgttgagcgcggcggctcgggcgcggcgcaaatcgcctttgcggtgcggcgcgtcaagggtgttttggtcgccggtgtaggcgtggatggtggtcatcagaccttcgactacgccgaactctttttgcaggactgccgccatcggggcaaggcagttggtggtgcaggaagcggcggagataacggtttcgctgccgtccaaaatgtcttggtttacgccatatacgacggttttcacatcattgccgccgggtgcggaaatcacgactttgcgcgcgccggccctgatgtgtgcttcggctttggttttattggtaaagaagccggtacattcgaggatgacatccacacccaactcgccccaaggcaattcttcgggattcggattggcaaaaactttgatctctttgccgtttaccacgatggcatcgtcttttaattcggcagtaccttggaaacggccttgtgtgctgtcgtatttgaaaaggtgcagcagcatttcggcaggggtcaggtcgttgacggcgacgacttcgatgtcgtgggctttttcaatttgacgcaatgcgaggcggccgatgcggccgaaaccgttaatcgctactttaatgctcatgtatatactccaagctgtgaaacgaaatttcaatacctgtattgtattctgaaataaagttacattccactattacatctaactacttgccgcttatttgatatagatgaattttactgtttgcacagatttccaaaacttttaccatcaatatttgaatttaaaattttaatgatgattttgatgattgccaacctgcttgtgcgtaagtagcaaatatccaatattttcattacctttttgtcaaataagtttgagtttaagacttgctgtataagacagataagcgtggatgttttttgacttaataatatttctgtggataactttgctgttttcctagttgtctccacaaccttattgacaggcttacggtcagtctcattccgtcgaagacaaaaccttttgctacaataccgttttcctaatgataaggcagccccatgtccaaatccgccgtttccccaatgatgcagcaatacctcggcatcaaagcgcaacataccgacaaactggtgttttaccgtatgggcgatttttacgagatgtttttcgacgatgcggtagaagcggcaaaacttttggatattaccctgaccacgcgcggacaggtggatggcgagccggtcaaaatggcaggcgtgccgtttcacgccgccgaacaatatctggcgcgcctggtcaagttgggcaaaagcgtggcgatttgcgaacaggtcggcgaagtcggcgcgggcaaagggcctgtggagcgcaaagtcgtgcgcatcgtaacgcccggcacgctgaccgattccgcattgctggaagacaaggaaaccaaccgcatcgttgccgtgtcccccgacaaaaaatacatcggtttggcgtgggcatcgctgcaaagcggcgaattcaaaaccaagctgacaactgtggataaattggacgacgaactggcgcgcctgcaggcggcggaaattctgttgcctgacagtaaaaacgcaccgcaacttcagacggcatcgggtgttacgcgcctgaacgcgtggcagtttgccgccgacgcgggggaaaaactgctgacggaatatttcggctgccaggatttgcgcggcttcggtttggacggcaaagaacacgccgttgcgattggcgcggcaggtgcactgttgaactatatccgtctgacgcaaaacctgatgccgcaacatttggacggcctgtcgctcgaaaccgacagccaatatatcggtatggatgccgccacgcgccgcaatctcgaaatcacgcaaaccctctccggcaaaaaatcgccgaccctgatgtccacgctcgacctttgcgctacccatatgggcagccgcctcttggctctctggctgcaccaccctttacgcaaccgcgcccacatccgagcgcgccaagaagccgttgccgcgctggaaagccaatacaaacccctccagtgccgtctgaaaagcattgccgacatcgaacgcatcgccgcccgtattgccgtgggtaacgcccgcccgcgcgacctcgccgccctgcgcgacagcctgtttgccctgtccgaaatcgaattgtccgccgagtgcagcagtctcttaggaaccctcaaagccgttttcccggaaaacctatccacagccgaacagctccgccaagccattttgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacacttaaagtcgagttcaaccgcgttcacggcttttacattgaattgtccaaaacccaagccgaacaagcacctgccgactaccaacgccggcaaacccttaaaaacgccgaacgcttcatcacgccggaactgaaagcctttgaagacaaagtgctgactgctcaagagcaagccctcgccttagaaaaacaactctttgacggcgtattgaaaaaccttcagacggcattgccgcagcttcaaaaagccgccaaagccgccgccgcgctggacgtgttgtccacattttcagccttggcaaaagagcggaacttcgtccgccccgagtttgccgactatccggttatccacatcgaaaacggccgccatcccgttgtcgaacagcaggtacgccacttcaccgccaaccacaccgaccttgaccacaaacaccgcctcatgctgctcaccggccccaatatgggcggcaaatccacctacatgcgccaagtcgcgctgattgttttattggcacacaccggctgttttgtgcctgccgatgccgccacaatcgggcccatcgatcaaatcttcacccgcatcggcgcatcggacgacctcgcctccaaccgctccactttcatggtcgaaatgagcgaaaccgcctacatcctgcatcacgccaccgaacaaagccttgttttaatggacgaagtcggacgtggtacttccactttcgacggcctcgccctcgcgcacgccgttgccgaacacctgctgcaaaaaaacaaatccttcagcctgtttgctacccactatttcgagctgacctacctgcccgaagcccacaccgccgccgtcaatatgcacctttccgcgctcgaacagggacaggacatcgttttcctgcaccaaatccaaccgggtcccgccggtaaaagctacggcattgccgtcgccaaactcgccggcctgcctgtacgcgcattgaaatccgcccaaaagcatttgaacggactggaaaaccaagccgccgcgaaccgtccccaactggatattttcagtaccatgccgtctgaaaaaggagatgaaccgaatgtgggcaactttgtggataaagcagaggaaaaacattttgaaggtatattggcagcagccttggaaaaactcgatcccgacagcctgaccccgcgcgaagcattgtcagaactgtaccgtctgaaagatttgtgcaaatccgtatcttaatttccgttgtcggaacagcatcaaaccatatggaaaaatctgtggataaacattatctgacaggaaatttccaaacataaaaaatgccgtccgaacagctcagacggcatccgtccattcggct

SEQ ID NO: 38834 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 38835 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 38836 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 38837 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 38838 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 38839 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 38840 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 38841 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 38842 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 38843 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 38844 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 38845 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 38846 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 38847 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 38848 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 38849 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 38850 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 38851 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 38852 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 38853 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 38854 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 38855 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 38856 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 38857 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 38858 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 38859 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 38860 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 38861 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 38862 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 38863 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 38864 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 38865 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 38866 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 38867 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 38868 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 38869 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 38870 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38871 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 38872 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 38873 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 38874 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 38875 - DNA, 341 bp, Neisseria meningitidis; identical to SEQ ID NO: 38874

SEQ ID NO: 38876 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 38877 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 38878 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 38879 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 38880 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 38881 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 38882 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 38883 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 38884 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 38885 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 38886 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 38887 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 38888 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 38889 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 38890 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 38891 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 38892 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 38893 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 38894 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 38895 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 38896 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 38897 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 38898 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 38899 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 38900 - DNA, 1248 bp, Neisseria gonorrhoeae; identical to SEQ ID NO: 38894

SEQ ID NO: 38901 - protein, 415 aa, Neisseria gonorrhoeae; identical to SEQ ID NO: 38895

SEQ ID NO: 38902 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 38903 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 38904 - DNA, 1764 bp, Neisseria meningitidis; identical to SEQ ID NO: 38898
  misc_feature (67)..(67): n is a, c, g, or t
  misc_feature (408)..(408): n is a, c, g, or t

SEQ ID NO: 38905 - protein, 587 aa, Neisseria meningitidis; identical to SEQ ID NO: 38899
  misc_feature (23)..(23): Xaa can be any naturally occurring amino acid

SEQ ID NO: 38906 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 38907 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 38908 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 38909 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 38910 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 38911 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 38912 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 38913 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 38914 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 38915 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 38916 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 38917 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 38918 - DNA, 657 bp, Neisseria meningitidis; identical to SEQ ID NO: 38914

SEQ ID NO: 38919 - protein, 218 aa, Neisseria meningitidis; identical to SEQ ID NO: 38915

SEQ ID NO: 38920 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 38921 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 38922 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 38923 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 38924 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 38925 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 38926 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 38927 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 38928 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 38929 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 38930 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 38931 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 38932 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 38933 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 38934 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 38935 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 38936 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 38937 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 38938 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 38939 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 38940 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 38941 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 38942 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 38943 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 38944 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 38945 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 38946 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 38947 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 38948 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 38949 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 38950 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 38951 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 38952 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 38953 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 38954 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 38955 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 38956 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 38957 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 38958 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 38959 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 38960 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 38961 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 38962 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 38963 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 38964 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 38965 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 38966 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 38967 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 38968 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 38969 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 38970 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 38971 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 38972 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 38973 - protein, 213 aa, Neisseria meningitidis; identical to SEQ ID NO: 38971

SEQ ID NO: 38974 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 38975 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 38976 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 38977 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 38978 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 38979 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 38980 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 38981 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 38982 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 38983 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 38984 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 38985 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 38986 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 38987 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 38988 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 38989 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 38990 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 38991 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 38992 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 38993 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 38994 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 38995 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 38996 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 38997 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 38998 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 38999 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 39000 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 39001 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 39002 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 39003 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 39004 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 39005 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 39006 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 39007 - protein, 173 aa, Neisseria meningitidis; identical to SEQ ID NO: 39005

SEQ ID NO: 39008 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 39009 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 39010 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 39011 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 39012 - DNA, 390 bp, Neisseria meningitidis; identical to SEQ ID NO: 39010

SEQ ID NO: 39013 - protein, 129 aa, Neisseria meningitidis; identical to SEQ ID NO: 39011

SEQ ID NO: 39014 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 39015 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 39016 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 39017 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 39018 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 39019 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 39020 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 39021 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 39022 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 39023 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 39024 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 39025 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 39026 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 39027 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 39028 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 39029 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 39030 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 39031 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 39032 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 39033 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 39034 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 39035 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 39036 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 39037 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 39038 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 39039 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 39040 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 39041 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 39042 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 39043 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 39044 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 39045 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 39046 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 39047 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 39048 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 39049 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 39050 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 39051 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 39052 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 39053 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 39054 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 39055 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 39056 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 39057 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 39058 - DNA, 360 bp, Neisseria meningitidis; identical to SEQ ID NO: 39056

SEQ ID NO: 39059 - protein, 119 aa, Neisseria meningitidis; identical to SEQ ID NO: 39057

SEQ ID NO: 39060 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 39061 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 39062 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 39063 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 39064 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 39065 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 39066 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 39067 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 39068 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 39069 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 39070 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 39071 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 39072 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 39073 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 39074 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 39075 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 39076 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 39077 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 39078 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 39079 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 39080 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 39081 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 39082 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 39083 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 39084 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 39085 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 39086 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 39087 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 39088 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 39089 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 39090 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 39091 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 39092 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 39093 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 39094 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 39095 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 39096 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 39097 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 39098 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 39099 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 39100 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 39101 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 39102 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 39103 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 39104 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 39105 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 39106 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 39107 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 39108 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 39109 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 39110 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 39111 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 39112 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 39113 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 39114 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 39115 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 39116 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 39117 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 39118 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 39119 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 39120 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 39121 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 39122 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 39123 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 39124 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 39125 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 39126 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 39127 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 39128 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 39129 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 39130 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 39131 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 39132 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 39133 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 39134 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 39135 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 39136 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 39137 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 39138 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 39139 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 39140 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 39141 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 39142 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 39143 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 39144 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 39145 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 39146 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 39147 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 39148 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 39149 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 39150 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 39151 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 39152 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 39153 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 39154 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 39155 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 39156 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 39157 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 39158 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 39159 - protein, 103 aa, Neisseria meningitidis; identical to SEQ ID NO: 39157

SEQ ID NO: 39160 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 39161 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 39162 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 39163 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 39164 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 39165 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 39166 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 39167 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 39168 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 39169 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 39170 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 39171 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 39172 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 39173 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 39174 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 39175 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 39176 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 39177 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 39178 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 39179 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 39180 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 39181 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 39182 - DNA, 378 bp, Neisseria meningitidis; identical to SEQ ID NO: 39180

SEQ ID NO: 39183 - protein, 125 aa, Neisseria meningitidis; identical to SEQ ID NO: 39181

SEQ ID NO: 39184 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 39185 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 39186 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 39187 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 39188 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 39189 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 39190 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 39191 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 39192 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 39193 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 39194 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 39195 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 39196 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 39197 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 39198 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 39199 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 39200 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 39201 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 39202 - DNA, 870 bp, Neisseria gonorrhoeae; identical to SEQ ID NO: 39196

SEQ ID NO: 39203 - protein, 289 aa, Neisseria gonorrhoeae; identical to SEQ ID NO: 39197

SEQ ID NO: 39204 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 39205 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 39206 - DNA, 870 bp, Neisseria meningitidis; identical to SEQ ID NO: 39200

SEQ ID NO: 39207 - protein, 289 aa, Neisseria meningitidis; identical to SEQ ID NO: 39201

SEQ ID NO: 39208 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 39209 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 39210 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 39211 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 39212 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 39213 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 39214 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 39215 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 39216 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 39217 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 39218 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 39219 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 39220 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 39221 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 39222 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 39223 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 39224 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 39225 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 39226 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 39227 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 39228 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 39229 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 39230 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 39231 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 39232 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 39233 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 39234 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 39235 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 39236 - DNA, 1056 bp, Neisseria meningitidis; identical to SEQ ID NO: 39230

SEQ ID NO: 39237 - protein, 351 aa, Neisseria meningitidis; identical to SEQ ID NO: 39231

SEQ ID NO: 39238 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 39239 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 39240 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 39241 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 39242 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 39243 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 39244 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 39245 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 39246 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 39247 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 39248 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 39249 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 39250 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 39251 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 39252 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 39253 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 39254 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 39255 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 39256 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 39257 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 39258 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 39259 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 39260 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 39261 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 39262 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 39263 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 39264 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 39265 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 39266 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 39267 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 39268 - DNA, 1101 bp, Neisseria gonorrhoeae; identical to SEQ ID NO: 38767

SEQ ID NO: 39269 - protein, 366 aa, Neisseria gonorrhoeae; identical to SEQ ID NO: 38768

SEQ ID NO: 39270 - DNA, 1101 bp, Neisseria meningitidis; identical to SEQ ID NO: 38765
  misc_feature (364)..(606): n is a, c, g, or t
  misc_feature (995)..(995): n is a, c, g, or t
  misc_feature (1082)..(1082): n is a, c, g, or t

SEQ ID NO: 39271 - protein, 366 aa, Neisseria meningitidis; identical to SEQ ID NO: 38766
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid

SEQ ID NO: 39272 - DNA, 1101 bp, Neisseria meningitidis; identical to SEQ ID NO: 38769

SEQ ID NO: 39273 - protein, 366 aa, Neisseria meningitidis; identical to SEQ ID NO: 38770

SEQ ID NO: 39274 - DNA, 1101 bp, Neisseria meningitidis; identical to SEQ ID NO: 38771
  misc_feature (995)..(995): n is a, c, g, or t
  misc_feature (1082)..(1082): n is a, c, g, or t

SEQ ID NO: 39275 - protein, 366 aa, Neisseria meningitidis; identical to SEQ ID NO: 38772
  misc_feature (332)..(332): Xaa can be any naturally occurring amino acid
  misc_feature (361)..(361): Xaa can be any naturally occurring amino acid

SEQ ID NO: 39276 - DNA, 1101 bp, Neisseria meningitidis; identical to SEQ ID NO: 38769

SEQ ID NO: 39277 - protein, 366 aa, Neisseria meningitidis; identical to SEQ ID NO: 38770

SEQ ID NO: 39278 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 39279 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 39280 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 39281 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 39282 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 39283 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 39284 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 39285 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 39286 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 39287 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 39288 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 39289 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 39290 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 39291 - protein, 1 aa, Neisseria gonorrhoeae
C

SEQ ID NO: 39292 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 39293 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 39294 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 39295 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 39296 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 39297 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 39298 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 39299 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 39300 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 39301 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 39302 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 39303 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 39304 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 39305 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 39306 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 39307 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 39308 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 39309 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 39310 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 39311 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 39312 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 39313 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 39314 - DNA, 2037 bp, Neisseria gonorrhoeae; identical to SEQ ID NO: 38777

SEQ ID NO: 39315 - protein, 678 aa, Neisseria gonorrhoeae; identical to SEQ ID NO: 38778

SEQ ID NO: 39316 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 39317 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 39318 - DNA, 2037 bp, Neisseria meningitidis; identical to SEQ ID NO: 38779

SEQ ID NO: 39319 - protein, 678 aa, Neisseria meningitidis; identical to SEQ ID NO: 38780

SEQ ID NO: 39320 - DNA, 1473 bp, Neisseria gonorrhoeae; identical to SEQ ID NO: 38783

SEQ ID NO: 39321 - protein, 491 aa, Neisseria gonorrhoeae; identical to SEQ ID NO: 38784

SEQ ID NO: 39322 - DNA, 2037 bp, Neisseria meningitidis; identical to SEQ ID NO: 38781

SEQ ID NO: 39323 - protein, 678 aa, Neisseria meningitidis; identical to SEQ ID NO: 38782

SEQ ID NO: 39324 - DNA, 2037 bp, Neisseria meningitidis; identical to SEQ ID NO: 38779

SEQ ID NO: 39325 - protein, 678 aa, Neisseria meningitidis; identical to SEQ ID NO: 38780

SEQ ID NO: 39326 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 39327 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 39328 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 39329 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 39330 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 39331 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 39332 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 39333 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 39334 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 39335 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 39336 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 39337 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 39338 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 39339 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 39340 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 39341 - protein, 38 aa, Neisseria meningitidis
MEPFKTLIWIVNLISALAVFVLVLLQHGKGADAGATFG

SEQ ID NO: 39342 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 39343 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 39344 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 39345 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 39346 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 39347 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 39348 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 39349 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 39350 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 39351 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 39352 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 39353 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 39354 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 39355 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 39356 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 39357 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 39358 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 39359 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 39360 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 39361 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 39362 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 39363 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 39364 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 39365 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 39366 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 39367 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 39368 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 39369 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 39370 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 39371 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 39372 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 39373 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 39374 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 39375 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 39376 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 39377 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 39378 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 39379 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 39380 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 39381 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 39382 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 39383 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 39384 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 39385 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 39386 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 39387 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 39388 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 39389 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 39390 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 39391 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 39392 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 39393 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 39394 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 39395 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 39396 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 39397 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 39398 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 39399 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 39400 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 39401 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 39402 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 39403 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 39404 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 39405 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 39406 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 39407 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 39408 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 39409 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 39410 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 39411 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 39412 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 39413 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 39414 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 39415 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 39416 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 39417 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 39418 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 39419 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39420 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 39421 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39422 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 39423 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 39424 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 39425 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 39426 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 39427 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 39428 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 39429 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 39430 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 39431 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39432 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 39433 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39434 - DNA, 2277 bp, Neisseria gonorrhoeae
atggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggcggggctggtcgatgttgccgatggaaaaatccccgaaaaaatgcctgaaaacggcgtatcgggcgaagccggattgcgtttgagcagcggcaatttagaaaaactgacatccgcaggcatcaatatcggactgggcaaaaacttcgtgctgcataccgaaggcttgtaccgcaaatcgggcgattacgccgtaccgcgttaccgcaatctgaaacgcctgcccgacagccatgccgattcgcaaacgggcagcatcgggctgtcttgggtgggcgaaaaaggctttatcggcgcagcatacagcgaccgtcgcgaccgctacggcctgcctgcccacagccacgaatacgatgattgccacgccgacatcatctggcaaaagagtttgatcaacaaacgctatttgcagctttatccgcacttgttgaccgaagaagacatcgattacgacaatccgggcttgagctgcggcttccacgacggcgacggtgcacacgcacacacccacaacggcaaaccgtggatagacctgcgcaacaaacgctacgaactccgcgccgaatggaagcagccattccccggttttgaagccctgcgcgtacatctgaaccgcaatgactaccaccacgacgaaaaagcaggcgatgcagtagaaaacttcttcaacaacaaaacacacaacgcccgtatcgagttgcgccaccaacccataggccgtctgaaaggcagctggggcgtgcaatatttgggacaaaaatccagcgcgctttccgccattcccgaaaccgtccaacaaccgatgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacgaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtaaacgtgaagttttaa

SEQ ID NO: 39435 - protein, 758 aa, Neisseria gonorrhoeae
MAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39436 - DNA, 2277 bp, Neisseria meningitidis
atggcacaaactacactcaaacccattgttttatcaattcttttaatcaacacacccctcctcgcccaagcgcatgaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 39437 - protein, 758 aa, Neisseria meningitidis
MAQTTLKPIVLSILLINTPLLAQAHETEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39438 - DNA, 2277 bp, Neisseria meningitidis
atggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 39439 - protein, 758 aa, Neisseria meningitidis
MAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 39440 - DNA, 1110 bp, Neisseria gonorrhoeae
tactgcaaggcagacccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcggggaaatcctagacctgctcggcatcaatccggcaacggaaatacaggcgggcggaaaaaccctgccggttgcctccgcactgttatcccatttcgaactcacgcaaaacacccccgcctttgtcaaaggctatgccacgttcgccgataatgacgaactcgaccgtattgctgccgacaacgccgttttgcaaggctttgtgcaaagcacgccgattgccggtgtgctgcaccgcttcccggcaaaactgacggcggaacaattcgccggcctgctgcgcccgcttgcgccgcgcctgtattcgatttcctcgtcgcaggcggaagcgggggacgaagtgcacctgaccgtcggcgcagtgcgtttcgaacacgaagggcgcgccagggcgggcggcgcatcgggtttctttgccgaccggctggaagaggacggcacggtgcgcgtgtttgcggaacgcaacgacggcttcaggctgcccgaagacagccgcaagccgattgtgatgatcggctccggtaccggcgtcgcaccgttccgcgccttcgtccaacaacgtgccgcagaaaatgcggaaggcagaaactggctgattttcggcaatccgcattttgccgccgacttcctctatcagaccgaatggcagcagtttgccaaagacggcttcctgcacagatatgacttcgcctggtcgcgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagaagtggaagccgccttgctggatgtgattatcggggcagggcattcggacgaagacggcgcagaaggatatttggatatgctgcgcgaagaaaaacgctatcagcgtgatgtttattga

SEQ ID NO: 39441 - protein, 369 aa, Neisseria gonorrhoeae
YCKADPFPAALLANQKITARQSDKDVRHIEIDLSGSDLHYLPGDALGVWFDNDPALVGEILDLLGINPATEIQAGGKTLPVASALLSHFELTQNTPAFVKGYATFADNDELDRIAADNAVLQGFVQSTPIAGVLHRFPAKLTAEQFAGLLRPLAPRLYSISSSQAEAGDEVHLTVGAVRFEHEGRARAGGASGFFADRLEEDGTVRVFAERNDGFRLPEDSRKPIVMIGSGTGVAPFRAFVQQRAAENAEGRNWLIFGNPHFAADFLYQTEWQQFAKDGFLHRYDFAWSRDQEEKIYVQDKIREQAEGLWQWLQEGAHIYVCGDAAKMAKEVEAALLDVIIGAGHSDEDGAEGYLDMLREEKRYQRDVY

SEQ ID NO: 39442 - DNA, 1800 bp, Neisseria meningitidis
atgcagaacacaaatccgccattaccgcctctgccgcccgaaatcacgcagctcctgtcggggctggacgcggcacaatgggcgtggctgtccggctacgcttgggcaaaagcaggaaacggggcatctgcaggactgcccgcgcttcagacggcattgccggcggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccgaaagaagccgtcgtgctgcacaaactgctgaacggcaaaaaagccccgaaattggacaaactccaatttgccgtactgggtttgggcgacagttcctatccgaatttctgtcaggcaggtaaagatttcgaccggcgttttgaagaattgggcgcaaaacggctgctcgaacgcgttgatgcggatttggactttaccgcctccgcaaacgcctggacagataatatcgccgcactcttaaaagaagaagccgcaaaaaaccgggcaacgcccgcgccgcagacaacgccccccgccggccttcagacggcaccggatggcaggtactgcaaggcagccccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatccggcaacggaaatacaggcgggcggaaagatgatgccggttgcgcgcgcactttcatctcatttcgaactcacgcaaaacactccggctttcgtcaaaggctatgccgcgttcgcccattatgaagaactcgataaaatcattgccgataacgccgttttgcaggatttcgtgcaaaacacgcctattgtcgatgtgctgcaccgcttcccggcaagcctgacggcagaacaattcatccgtttactgcgtccgcttgcaccccgtttgtattcgatttcttcagcacaggcggaagtgggcgatgaagtgcatttaactgtcggcgtggttcgttttgaacacgaaggccgcgccagaacgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgattttcggcaatccgcattttgcccgtgattttctctatcaaaccgaatggcagcagtttgccaaagacggcttcctgcacaggtacgatttcgcctggtcccgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattga

SEQ ID NO: 39443 - protein, 599 aa, Neisseria meningitidis
MQNTNPPLPPLPPEITQLLSGLDAAQWAWLSGYAWAKAGNGASAGLPALQTALPAAEPFSVTVLSASQTGNAKSVADKAADSLEAAGIQVSRAELKDYKAKNIAGERRLLLVTSTQGEGEPPKEAVVLHKLLNGKKAPKLDKLQFAVLGLGDSSYPNFCQAGKDFDRRFEELGAKRLLERVDADLDFTASANAWTDNIAALLKEEAAKNRATPAPQTTPPAGLQTAPDGRYCKAAPFPAALLANQKITARQSDKDVRHIEIDLSGSDLHYLPGDALGVWFDNDPALVREILDLLGIDPATEIQAGGKMMPVARALSSHFELTQNTPAFVKGYAAFAHYEELDKIIADNAVLQDFVQNTPIVDVLHRFPASLTAEQFIRLLRPLAPRLYSISSAQAEVGDEVHLTVGVVRFEHEGRARTGGASGFLADRLEEDGTVRVFVERNDGFRLPEDSRKPIVMIGSGTGVAPFRAFVQQRAAENAEGKNWLIFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 39444 - DNA, 1800 bp, Neisseria meningitidis
atgcagaacacaaatccgccattaccgcctatgccgcccgaaatcacgcagctcctgtcggggctggacgcggcacaatgggcgtggctgtccggctacgcttgggcaaaagcaggaaacggggcatctgcaggactgcccgcgcttcagacggcattgccgacggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccggaagaagccgtcgtgctgcacaaactgctgaacggcaaaaaagccccgaaattggacaaactccaatttgccgtactgggtttgggcgacagctcctatccgaatttctgccgggcgggcaaagatttcgacaaacgttttgaagaattgggcgcaaaacgcctgctcgaacgcgttgatgcggatttggactttgccgccgccgcagacggatggacagataatatcgccgcactcttaaaagaagaagccgcaaaaaaccgggcaacgcccgcgccgcagacaacgccccccgccggccttcagacggcaccggatggcaggtactgcaaggcagacccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatcaggcaacggaaatacaggcgggcggaaaaaccctgccggttgcctccgcactgttatcccattttgaactcacgcaaaacacccccgcctttgtcaaaggctatgccccgttcgccgatgatgacgaactcgaccgtattgctgccgacaacgccgttttgcaaggctttgtgcaaagcacgccgattgccgatgtgctgcaccgcttcccggcaaaactgacagcggaacaattcgccggcctactgcgcccgcttgcgccgcgcctgtattcgatttcctcgtcgcaggcggaagtgggggacgaagtgcacctgaccgtcggcgcggtgcgtttcgaacacgaagggcgcgccagggcgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgtttttcggcaatccgcattttgcccgtgattttctctatcaaaccgaatggcagcagtttgccaaagacggcttcctgcacagatacgatttcgcctggtcgcgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattga

SEQ ID NO: 39445 - protein, 599 aa, Neisseria meningitidis; identical to SEQ ID NO: 16632

SEQ ID NO: 39446 - DNA, 1812 bp, Neisseria gonorrhoeae
atgaaacaaatccgcaacatcgccatcatcgcacacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctgccacatcaatatcgtcgacacgccgggacacgccgacttcggcggcgaagtggagcgcgttttggggatggtggattgcgtcgtcttgttggtggacgcacaggaaggtccgatgccgcaaacccgtttcgtgaccaaaaaagccttggctttggggctgaaaccgattgtcgtcatcaacaaaatcgacaaaccgtccgcccgtccgagctgggttatcgaccagactttcgagttgttcgacaacttgggtgcgaccgacgagcagttggatttcccgattgtttacgcttcaggtttgagcggctttgccaagctggaagaaaccgacgagagcagcgatatgcgcccgctgttcgacaccatcctaaaatacacgcctgcaccgagcggcagcgcggacgagccgctgcaactgcaaatttcccaactcgactacgacaactacaccggccgcctcggtatcggtcgtatcttgaacggacgcatcaaacccggccaaaccgttgccgtgatgaaccacgagcagcaaatcgcccaaggccgcatcaaccagcttttgggtttcaaaggcttggaacgcgtgccgcttgaagaagccgaagccggcgacattgtgattatttccggtatcgaagacatcggcatcggcgtaaccatcaccgacaaagacaaccccaaaggcctgccgatgttgagcgtggacgaaccgacgctgacgatggactttatggtaaacaccagcccgctcgcaggtacagaaggcaaattcgtgaccagccgccaaatccgcgaccgcctgcaaaaagaattgctgaccaacgttgccctgcgcgtggaagacaccgccgatgccgacgtgttccgcgtatccgggcgcggcgaactgcacctgacgattttgctggaaaatatgcgccgcgaaggctacgaactcgccgtcggcaagccgcgcgtcgtgtaccgagacatcgacggtcaaaaatgcgaaccttatgaaaacctgactgtggacgtacccgacgacaaccaaggcgcggtaatggaagaactcggccgccgccgtggcgaactgaccaatatggaaagcgacggcaacggacgcacccgcctcgaataccatattccagcgcgcggcttgatcggtttccaaggcgaattcatgaccctgacgcgcggcgtcgggctgatgagccacgtgttcgacgactacgcgcccgtcaaacccgatatgcccggccgccacaacggcgtactggtgtcccaagagcagggcgaggcggttgcttacgccttgtggaatcttgaagaccgcggccgtatgttcgtatcgcccaacgacaaaatctacgaaggtatgattatcggcatccacagccgcgacaacgatttggtggtcaacccgctcaaaggcaaaaaactcaccaatatccgtgccagcggtaccgacgaagcggtgcgcctgaccacgccgatcaaactgacgctggaaggcgcggtcgagtttatcgacgatgacgagctggtggaaatcacgccgcaatccatccgcctgcgcatgcgttacctgagcgaattggaacgccgccgtcattttaaaaagctggattaa

SEQ ID NO: 39447 - protein, 603 aa, Neisseria gonorrhoeae
MKQIRNIAIIAHVDHGKTTLVDQLLRQSGTFRANQQVDERVMDSNDLEKERGITILAKNTAIDYEGCHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKYTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRMRYLSELERRRHFKKLD

SEQ ID NO: 39448 - DNA, 1812 bp, Neisseria meningitidis
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaacaaaatcgacaagccgtccgctcgtccgagctgggttatcgaccaaactttcgagctgttcgacaacttgggcgcgaccgacgagcagttggatttcccgattgtttacgcttcagggttgagcggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgcatcaaacccggccaaaccgttgccgtcatgaaccacgatcagcaaatcgcccaaggccgcatcaaccagcttttgggtttcaaaggtttggaacgcgtgccgcttgaagaagccgaagccggcgacatcgtgattatttccggtatcgaagacatcggtatcggcgtaaccatcaccgacaaagacaatcccaaaggcctaccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggatgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggcatgattatcggcatccacagtcgcgacaacgatttggtggtcaacccgctcaaaggcaaaaaacttaccaacatccgtgccagcggtaccgacgaagccgttcgcctgaccacgccaatcaagctgacgctggaaggtgcggttgagtttatcgacgatgacgaactcgttgaaatcacgccgcaatccatccgtctgcgcaagcgttacttgagcgaattggaacgccgccgccactttaaaaagctggattga

SEQ ID NO: 39449 - protein, 603 aa, Neisseria meningitidis
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQTVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 39450 - DNA, 1812 bp, Neisseria meningitidis
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgagttttggggatggtggactgcgtcgtcttgttggtggacgcgcaggaaggcccgatgccgcaaacccgtttcgtgaccaaaaaagccttggctttggggctgaaaccgattgtcgtcatcaataaaatcgacaaaccgtccgcccgtccgagctgggtcatcgaccaaactttcgagctgttcgacaacttgggcgcgaccgacgagcagttggatttcccgattgtttatgcttccggtctgtccggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgtatcaagcccggtcaagttgttgccgtcatgaaccacgatcaacaaatcgcccaaggccgcatcaaccagcttttgggtttcaaaggtttagaacgcgtgccgcttgaagaagccgaagccggcgacatcgtgattatttccggtattgaagacatcggcatcggcgtaaccatcaccgacaaagacaaccccaaaggcctgccgatgttgagcgtggacgaaccgacgctgacgatggactttatggtcaacaccagcccgttggcaggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggacgtacccgacgacaaccaaggcgcggtaatggaagaactcggccgccgccgtggcgaactgactaatatggaaagcgacggcaacggacgcacccgcctcgaataccatattccagcgcgcggcttgatcggcttccaaggcgaatttatgaccctgacgcgcggggtcgggctgatgagccacgtgttcgacgattacgcgcccgtcaaacccgatatgcctggccgccacaacggcgtgctggtgtcccaagagcagggcgaggcagtcgcttacgccttgtggaatctggaagaccgcggccgtatgttcgtatcgcccaacgacaaaatctacgaaggtatgattatcggcatccacagtcgcgacaacgatttggtggtcaacccgctcaaaggcaaaaaacttaccaacatccgtgccagcggtaccgacgaagccgttcgcctgaccacgccgattaagctgacgctggaaggtgcggtcgagtttatcgacgatgatgagctggtagaaatcacgccgcaatccatccgtctgcgcaagcgttacttgagcgaattggaacgccgccgccatttcaaaaagctagattga

SEQ ID NO: 39451 - protein, 603 aa, Neisseria meningitidis
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQVVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 39452 - DNA, 657 bp, Neisseria gonorrhoeae
atgaaaaacaaaaccaaagtctgggacttccccacccgccttttccactggctgcttgccgcatccctgccctttatgtggtatagcgcaaaagccggcggcgatatgctgcaatggcacacgcgcgtcgggctgctcgtccttttcctgctcgtattccgcctctgctggggcatttggggcagcgataccgcccgtttctcccgtttcgtccgaggttgggcaggtatacgcggctatctgaaaaacggcattcccgaacatatccagcccggacacaaccccttgggcgcactgatggtcgttgcgcttttggccgccgtctcatttcaagtcggcacggggctttttgccgccaatgaaaacaccttcagcaccaacggctacctcaaccatttggtttccgaacatacgggcagccttatacggaaaatccacctcaactttttcaagctgctcgccgttttttccgcagtccacatcgccgccgtcgccgcataccgcatattcaaaaagaaaaacctcgtccgcccgatgataaccggcttcaaatacatcgaaggcaaaacctcaatccgctttgccggcaaagccgcgcttgccgccgcattatcggttgccgcgcttgccgcagccgccatcctgctcctgtcctga

SEQ ID NO: 39453 - protein, 218 aa, Neisseria gonorrhoeae
MKNKTKVWDFPTRLFHWLLAASLPFMWYSAKAGGDMLQWHTRVGLLVLFLLVFRLCWGIWGSDTARFSRFVRGWAGIRGYLKNGIPEHIQPGHNPLGALMVVALLAAVSFQVGTGLFAANENTFSTNGYLNHLVSEHTGSLIRKIHLNFFKLLAVFSAVHIAAVAAYRIFKKKNLVRPMITGFKYIEGKTSIRFAGKAALAAALSVAALAAAAILLLS

SEQ ID NO: 39454 - DNA, 657 bp, Neisseria meningitidis
atgaaaaacaaaaccaaagtctgggacctccccacccgccttttccactggctgcttgccgcgtccctgccctttatgtggtatagcgcgaaagccggcggcgatatgctgcaatggcacacgcgcgtcgggctgttcgtccttttcctgctcgtatttcgcctctgctggggcatttggggcagcgataccgcccgtttttcccgtttcgtccaaggctgggcaggcatacgcggctatctgaaaaacggtattcccgaacacatccagcccggacacaaccccttgggcgcactgatggtcgttgcgcttttggccgccgtgtccttccaagtcggcaccgggctttttgccgccgatgaaaacaccttcagcaccaacggctacctcaaccatttggtttccgaacatacgggcagccttatgcggaaaatccacctcaactttttcaagctgctcgccgttttttctgcaatccacatcgccgccgtcgccgcataccgcgtattcaaaaagaaaaacctcatcctcccgatgataaccggcttcaaatacatcgaaggcaaaacctcaatccgctttgcaggcaaagccgcgcttgccgccgcattatcggttgcctcgcttgccgcagccgccatcctgctcctgtcctga

SEQ ID NO: 39455 - protein, 218 aa, Neisseria meningitidis
MKNKTKVWDLPTRLFHWLLAASLPFMWYSAKAGGDMLQWHTRVGLFVLFLLVFRLCWGIWGSDTARFSRFVQGWAGIRGYLKNGIPEHIQPGHNPLGALMVVALLAAVSFQVGTGLFAADENTFSTNGYLNHLVSEHTGSLMRKIHLNFFKLLAVFSAIHIAAVAAYRVFKKKNLILPMITGFKYIEGKTSIRFAGKAALAAALSVASLAAAAILLLS

SEQ ID NO: 39456 - DNA, 657 bp, Neisseria meningitidis
  misc_feature (488)..(488): n is a, c, g, or t
atgaaaaacaaaaccaaagtctgggacttccccacccgccttttccactggctgcttgccgcatccctaccctttatgtggtatagcgcgaaaaccggcggcgatatgctgcaatggcacacgcgcgtcgggctgtttatccttttcctgctcgtattccgcctctgctggggcatttggggcagcgataccgcccgtttctcccgtttcgtccgcggatggtcgggtatcagagagtatatgaaaaacggtattcccgaacacgtccaacccggacacaaccccttgggcgcactgatggtcgttgcgcttttggccgccgtgtcgttccaagtcggcacagggctttttgccgccgatgtaaacaccttcagcaccaacggctacctcaaccatttggtttccgaacatacgggcagccttatgcggaaaatccatctcaactttttcaaactgctcgccgttttttccgcagtccacatcgccgncgtcgccgcataccgcgtgttcaaaaagaaaaacctcgtcctcccgatgataaccggcttcaaatacatcgaaggcaaaacctcaatccgctttgccggcaaagccgcgcttgccgccgcattatcggttgccgcgcttgccgcagccgccatcctgctcctgtcctga

SEQ ID NO: 39457 - protein, 218 aa, Neisseria meningitidis
  misc_feature (163)..(163): Xaa can be any naturally occurring amino acid
MKNKTKVWDFPTRLFHWLLAASLPFMWYSAKTGGDMLQWHTRVGLFILFLLVFRLCWGIWGSDTARFSRFVRGWSGIREYMKNGIPEHVQPGHNPLGALMVVALLAAVSFQVGTGLFAADVNTFSTNGYLNHLVSEHTGSLMRKIHLNFFKLLAVFSAVHIAXVAAYRVFKKKNLVLPMITGFKYIEGKTSIRFAGKAALAAALSVAALAAAAILLLS

SEQ ID NO: 39458 - DNA, 1077 bp, Neisseria gonorrhoeae
atggggtttgcttacagtatgacgtatatcgaggtcgggataccggaggcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgaggcaggcgatgatggtggatgtgttttttgtttccactctggtggcgtatatcaagctctcgtctgtggcaaaggttcgcttcgggccggcgttttatctgatgttcgcgctgtcggttatgctgattcggacttcggtatcggttccccagcattgggtgtatttccaaatcgggcggctgacggggaataatgcggttcagacggcatcggaaggcaaaacctgttgcagccgctgcctgtatttccgcgacagtgccgaatccccctgcggggtgtgcggcgcggaactgtacggcggacggccgaaaagtctgagtatttcgtcggcgtttctgacggcggcggttgttttgtatttccctgccaatatcctgccgattatgatttcgtccaatcctgccgccacggaggccaacaccatctttagcggcatcgcttatatgtgggacgagggcgacaggctgattgcggcggttattttcagcgcgagtattttggtgccggtgctgaagattgcggcaatgtcggttttgattgcggcggcacggttcgctttgccggcgggcgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattttgacgatgctgtccgcctattatttcgacccgcgcctgctttgggacaaacgcgcttcagacggcattgctttcaacgaaacggaaaaatatgactga

SEQ ID NO: 39459 - protein, 358 aa, Neisseria gonorrhoeae
MGFAYSMTYIEVGIPEAASVLSLPEMMRLMVFQDYGFLAEVMFVLTFGAPVLFLLLCLYVYAALIRKQAYPALRLATRVMVRLRQAMMVDVFFVSTLVAYIKLSSVAKVRFGPAFYLMFALSVMLIRTSVSVPQHWVYFQIGRLTGNNAVQTASEGKTCCSRCLYFRDSAESPCGVCGAELYGGRPKSLSISSAFLTAAVVLYFPANILPIMISSNPAATEANTIFSGIAYMWDEGDRLIAAVIFSASILVPVLKIAAMSVLIAAARFALPAGAKKLSHLYRITEAVGRWSMIDIFVIIILMCSFHTYAARVIPGSAAVYFCLVVILTMLSAYYFDPRLLWDKRASDGIAFNETEKYD

SEQ ID NO: 39460 - DNA, 1077 bp, Neisseria meningitidis
atggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcgggccggcgttttatctgatgttcgcgctgtcagttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactga

SEQ ID NO: 39461 - protein, 358 aa, Neisseria meningitidis
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGPAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 39462 - DNA, 1077 bp, Neisseria meningitidis
atggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgaccttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcggatcggcgttttatctgatgttcgcgctgtcggttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactga

SEQ ID NO: 39463 - protein, 358 aa, Neisseria meningitidis
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGSAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 39464 - DNA, 1662 bp, Neisseria gonorrhoeae
atgactgacaacagccctcctccaaacggacacgctcaagcacgcgtccgcaaaaacaacaccttcctctccgccgtctggctggtcccgctgatcgcgctgattgccggcggctggctttgggttaaggaaatccgcaacagggggcctgtggttacgctcttgatggacagcgcggaaggcatcgaagtcaacaatacggtcattaaggtattgagcatcgatgtcggacgcgttacccgaatcaaactgcgcgacgaccaaaaaggcgtggaagttactgcccaactcaatgcggacgtatccggcctcatccgcagcgatacccagttttgggtggtcaagccgcgtatcgaccaaagcggcgtaaccggtttgggtacgctgctttcgggttcgtacatcgcttttacacccggcaaaagcggcgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaactttatggtcgggcaaatcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcaggcgcgatttcatttgattcgccgaaaaccaaaaacagtaaaaacgtcaaaagcgaggacagcttcacgctttacgacagccgcagcgaaatcgccaacctgcctgacgaccgctcgctgtactacaccgcgtttttcaaacaatccgtgcgcggactgaccgtcggttcgcctgtcgaatacaaagggctgaatgtcggcatggtttccgatgtcccttattttgaccgcaatgacagcctgcacctgtttgaaaacggctggattcccgtacgcatccgcatcgagccttcccgtttggaaatcaatgccgacgagcaaagcaaagagcattggaaacaacaattccagacggccttaaacaaaggcctgaccgccaccatctccagcaacaacctgctgaccggcggcaaaatgattgagttgaacgatcagccttccgcctcgcccaagctgcgaccgcataccgtttatgcaggcgataccgtcatcgccacacggggcggcggtttggatgacttgcaggtcaaattggcggatttgctggacaaattcaacaatctgccattggataaaaccgttgccgaattgaacggctcgctcgccgaactcaagtccgcactcaaatccgccaatgccgccctaagctccattgacaaactggtcggcaatccgcagacgcaaaacatcccgaacgaactgaaccaaactctgaaagagttgcgcataaccctgcaaggcgtatcgcctcaatcgcctatctacggagacgtacaaaatacgctgcaaagtttggacaaaaccttaaaagacgttcaacccgtcattaacactttgaaagaaaaacccaacgcactgattttcaacaacagcagcaaagaccctatcccgaaaggaagccgataa

SEQ ID NO: 39465 - protein, 553 aa, Neisseria gonorrhoeae
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSGEAKDVFQVQDIPPVTAIGQSGLRLNLIGKNDRILNVNSPVLYENFMVGQIESAHFDPSDQSVHYTIFIQSPNDKLIHSASRFWLESGINIETTGSGIKLNSAPLPALLSGAISFDSPKTKNSKNVKSEDSFTLYDSRSEIANLPDDRSLYYTAFFKQSVRGLTVGSPVEYKGLNVGMVSDVPYFDRNDSLHLFENGWIPVRIRIEPSRLEINADEQSKEHWKQQFQTALNKGLTATISSNNLLTGGKMIELNDQPSASPKLRPHTVYAGDTVIATRGGGLDDLQVKLADLLDKFNNLPLDKTVAELNGSLAELKSALKSANAALSSIDKLVGNPQTQNIPNELNQTLKELRITLQGVSPQSPIYGDVQNTLQSLDKTLKDVQPVINTLKEKPNALIFNNSSKDPIPKGSR

SEQ ID NO: 39466 - DNA, 1662 bp, Neisseria meningitidis
atgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaattttatggtcgggcaagtcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgacgaccgctcgctgtactacaccgcgtttttcaaacaatccgtgcgcggcctgaccgtcggttcgcccgtcgagtacaaagggctgaatgtcggcgtggtttccgacgttccttatttcgaccgcaacgacagcctgcacctgtttgaaaacggctggatacccgtacgcatccgcattgaaccttcccgtttggaaatcaatgccgacgaacaaagcaaagaacattggaaacaacaatttcagacggccttaaacaaaggcctgaccgccaccatctccagcaacaacctgctgaccggaagcaaaatgattgagttgaacgatcagccttccgcatcacctaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgccgcaatcgcctatctacggcgacgtacaaaatacgctgcaaagtttggacaaaactttaaaagacgttcaacccgtgattaatactttgaaagaaaaacccaacgcgctgattttcaacagcagcagcaaagaccctatcccgaaaggaagccgataa

SEQ ID NO: 39467 - protein, 553 aa, Neisseria meningitidis
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSDEAKDVFQVQDIPPVTAIGQSGLRLNLIGKNDRILNVNSPVLYENFMVGQVESAHFDPSDQSVHYTIFIQSPNDKLIHSASRFWLESGINIETTGSGIKLNSAPLPALLSGAISFDSPKTKNSKNVKSEDSFTLYDSRSEVANLPDDRSLYYTAFFKQSVRGLTVGSPVEYKGLNVGVVSDVPYFDRNDSLHLFENGWIPVRIRIEPSRLEINADEQSKEHWKQQFQTALNKGLTATISSNNLLTGSKMIELNDQPSASPKLRPHTVYAGDTVIATQGGGLDDLQVKLADLLDKFDKLPLDKTVAELNGSLAELKSTLKSANAALSSIDKLVGKPQTQNIPNELNQTLKELRTTLQGVSPQSPIYGDVQNTLQSLDKTLKDVQPVINTLKEKPNALIFNSSSKDPIPKGSR

SEQ ID NO: 39468 - DNA, 1662 bp, Neisseria meningitidis
atgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaactttatggtcgggcaagtcgaaagcgcgcatttcgacccgtccgaccaaagcgtgcattacaccatcttcatccaaagccccaacgacaaactgattcattccgccagccgtttctggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgatgaccgttcgctgtactacaccgcgtttttcaaacaatccgtgcgcggactgaccgtcggttcgcctgtcgagtacaaagggctgaatgtcggcgtggtttccgatgttccttatttcgaccgcaacgacagcctgcacctgtttgaaaacggctggattcccgtacgcatccgtattgagccttcccgtttggaaatcaatgccgacgaacaaagcaaagaacattggaaacaacaatttcagacggccttaaacaaaggcctgaccgccaccatctccagcaacaacctgctgaccggcagcaaaatgattgagttgaacgatcagccttccgcctcgcccaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgcctcaatcgcctatctacggcgacgtacaaaatacgctgcaaagtttggacaaaaccttaaaagacgttcaacccgtcattaacactttgaaagaaaaacccaacgcgctgattttcaacagcagcagcaaagaccctatcccgaaaggaagccgataa

SEQ ID NO: 39469 - protein, 553 aa, Neisseria meningitidis; identical to SEQ ID NO: 39467

SEQ ID NO: 39470 - DNA, 1539 bp, Neisseria gonorrhoeae
atgaaaatcggtatcccacgcgagtcattatccggcgaaacccgcgtagcctgcacgcccgccaccgttgccctgctgggcaaactaggctttgaaaccgttgtcgaaagcggtgcaggtttggcggcaagtttggacgatgccgcttaccaaacagcaggcgcaaccgttgccgacaaagcggcggtttgggcctgccctttaatttataaggtcaacgcgccgtccgaaggcgagctgccgctgctcaaagaaggtcaaaccatcgtcagcttcctgtggccgcgccaaaacgaggctttggtcgaggccttgcgcgccaagaaagtcaacgcgctggcgatggacatggttccccgcatttcccgcgctcaggccttggacgctttgtcttcaatggcaaacatcagcggctaccgcgccgtgattgaagccgccaacgccttcggccgtttcttcaccggtcaaatcactgccgccggcaaagtgccgcctgcgcaggttttggtgattggcgccggtgtggcgggtttggcggcaatcggtacggcaaattcgctcggcgcagtggtgcgcgcgttcgatacccgcttggaagtggcggaacaaatcgaatcgatgggcggtaagttcctgaaactcgacttcctgcaagaatcgggcggcagcggagacggctacgccaaagtgatgagcgacgaatttatcgccgccgaaatgaagctctttgccgaacaggcgaaagaagtggacatcatcatcaccaccgccgccattccgggcaaacccgctcccaagctgattaccaaagaaatggtggaaagcatgaaatccggatccgtcatcgtcgatttggcggcgacgggcggcaactgcgaactcacccgaccgggcgaattgtccgtaaccggcaacggcgtgaaaatcatcggctacaccgacatggcaaaccgccttgccggacagtcttcccagctttacgccaccaacttggtgaacctgaccaagctgttaagcccgaacaaagacggcgaaatcacgctggacttcgaagacgtgattatccgcaatatgaccgttacccgcgacggcgaaatcaccttcccgcctccgccgattcaggtttccgcccggccgcagcaaacgccgtctgaaaaagccgcgcctgccgccaagcccgagccgaaacctgttcccctgtggaaaaaactcgcgcccgccgccatcgccgccgtattggtgctgtgggtcggcgcggtcgcacccgcagcattcttgaaccactttatcgtcttcgtcctcgcctgcgtcatcggctaccatgtcgtttggaacgtcagccactcgctgcacacaccgctgatgtcggtaaccaacgccatctccggcatcatggtcgtcggcgcgctgctgcaaatcggtcagggcaacggcttcgtttcgctgctgtcgtttgttgccatcctgattgccggcatcaatatcttcggcggctttgcggttacacggcgtatgctgaatatgtttaagaaagggtaa

SEQ ID NO: 39471 - protein, 512 aa, Neisseria gonorrhoeae
MKIGIPRESLSGETRVACTPATVALLGKLGFETVVESGAGLAASLDDAAYQTAGATVADKAAVWACPLIYKVNAPSEGELPLLKEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFLQESGGSGDGYAKVMSDEFIAAEMKLFAEQAKEVDIIITTAAIPGKPAPKLITKEMVESMKSGSVIVDLAATGGNCELTRPGELSVTGNGVKIIGYTDMANRLAGQSSQLYATNLVNLTKLLSPNKDGEITLDFEDVIIRNMTVTRDGEITFPPPPIQVSARPQQTPSEKAAPAAKPEPKPVPLWKKLAPAAIAAVLVLWVGAVAPAAFLNHFIVFVLACVIGYHVVWNVSHSLHTPLMSVTNAISGIMVVGALLQIGQGNGFVSLLSFVAILIAGINIFGGFAVTRRMLNMFKKG

SEQ ID NO: 39472 - DNA, 1542 bp, Neisseria meningitidis
atgaaaatcggtatcccacgcgagtcattatccggcgaaacccgcgtcgcctgtacgcccgccaccgtcgccctgctgggcaaactgggctttgaaaccgttgtcgaaagcggtgcaggtttggcggcaagtttggacgatgccgcttaccaaacagcaggcgcaaccgttgccgacaaagcggcggtttgggtctgccctttgatttataaggtcaacgcgccgtccgaacaggaactgccgcttttgaacgaaggtcaaaccatcgtcagcttcctgtggccgcgccaaaacgaggctttggtcgaagccttgcgcgccaagaaagtgaacgcgctggcgatggatatggtgccccgcatttcgcgcgcgcaggctttggacgctttgtcttcgatggcaaacatcagcggctaccgcgccgtaattgaagccgccaacgccttcggccgtttcttcaccggtcaaattaccgccgccggcaaagtgccgcccgcgcaggttttggtgattggtgcaggtgtggcaggtttggcggcgatcggtacggcaaactcgctcggcgcagtggtacgcgcgttcgatacccgcttggaagtggcggaacaaatcgaatcgatgggcggcaagttcctgaaactcgacttcccacaagaatcgggcggcagcggagacggctacgccaaagtgatgagcgacgaatttatcgcagccgagatgaagctctttgccgagcaggcgaaagaagtggacatcatcatcaccaccgccgccattccgggcaaacccgcgcccaagctgattaccaaagaaatggtggaaagcatgaaatccggctccgtcatcgtcgatttggcggcggcgacgggcggcaactgcgaactcacccgcccgggcgaattgtccgtaaccggcaacggcgtgaaaatcatcggctacaccgacatggcaaaccgccttgccggacagtcttcccagctttacgccaccaacttggtcaacctgaccaagctgttaagcccgaacaaagacggcgaaatcacgttggacttcgaagacgtgattatccgcaacatgaccgttacccacgacggcgaaatcaccttcccgcctccgccgattcaagtttccgcccagccgcagcaaacgccgtctgaaaaagccgtgcctgccgccaagcccgagccaaaacccgttcccctgtggaaaaaactcgcgcccgccgtcatcgccgccgtcttggtactgtgggtcggcgcggtcgcacccgcagcattcctgaaccactttatcgtgttcgttctcgcctgcgtcatcggctactacgtcgtctggaacgtcagccactcgctgcacacaccgctgatgtcggtaaccaacgccatctccggcatcatcgtcgtcggcgcgctgctgcaaatcggtcagggcaacggcttcgtttcgctgctgtcgtttgttgccatcctgattgccggcatcaacatcttcggcggctttgcggtaacacggcgtatgctgaatatgtttaagaaagggtaa

SEQ ID NO: 39473 - protein, 513 aa, Neisseria meningitidis
MKIGIPRESLSGETRVACTPATVALLGKLGFETVVESGAGLAASLDDAAYQTAGATVADKAAVWVCPLIYKVNAPSEQELPLLNEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFPQESGGSGDGYAKVMSDEFIAAEMKLFAEQAKEVDIIITTAAIPGKPAPKLITKEMVESMKSGSVIVDLAAATGGNCELTRPGELSVTGNGVKIIGYTDMANRLAGQSSQLYATNLVNLTKLLSPNKDGEITLDFEDVIIRNMTVTHDGEITFPPPPIQVSAQPQQTPSEKAVPAAKPEPKPVPLWKKLAPAVIAAVLVLWVGAVAPAAFLNHFIVFVLACVIGYYVVWNVSHSLHTPLMSVTNAISGIIVVGALLQIGQGNGFVSLLSFVAILIAGINIFGGFAVTRRMLNMFKKG

SEQ ID NO: 39474 - DNA, 1541 bp, Neisseria meningitidis
  misc_feature (386)..(386): n is a, c, g, or t
  misc_feature (395)..(395): n is a, c, g, or t
  misc_feature (456)..(456): n is a, c, g, or t
  misc_feature (799)..(801): n is a, c, g, or t
  misc_feature (803)..(803): n is a, c, g, or t
  misc_feature (805)..(805): n is a, c, g, or t
  misc_feature (1224)..(1224): n is a, c, g, or t
  misc_feature (1226)..(1226): n is a, c, g, or t
atgaaaatcggtatcccacgtgagtcattatccggcgaaacccgcgtcgcctgtacgcccgccaccgtcgccctgctgggcaaactgggctttgaaaccgttgtcgaaagcggcgcaggtttggcggcaagtttggacgatgccgcttaccaagcagcaggcgcaaccgttgccgacaaagcagcggtttgggcataccctttaatttataaggttaacgcgccgtccgaagacgagctgccgctgctcaaagaaggacagaccatcgtcagcttcctgtggccgcgccaaaacgaggctttggtcgaagccttgcgcgccaagaaagtgaacgcgctggcaatggacatggtgccccgcatttcgcgcgcgcaggctttggacgntttgtcttngatggcaaacatcagcggctaccgcgccgtgattgaagccgccaacgccttcggccgtttnttcaccggccaaattactgccgcaggcaaagtgccgcccgcgcaggttttggtgattggtgcaggtgtggcaggtttggcggcgatcggtacggcaaactcgctcggcgcagtggtacgcgtgttcgatacccgcctgaagtggcggaacaattagaatcgatgggcggcaagttcctgaaactcgacttcccgcaagaatcgggcggcagcggcgacggctacgccaaagtgatgagcgacgaatttatcgccgccgagatgaagctttttgccgagcaggcgaaagaagtggacatcatcatcaccaccgccgccattccgggcaaacccgcgcccaagcnnntnancaaagaaatggtcgaaagcatgaaacccggctccgtcatcgtcgatttggcggcggcgacgggcggcaactgcgaactcaccaaacagggcgaattgttcgtaaccggcaacggcgtgaaaatcatcggctacaccgacatggcaaaccgccttgccggacagtcttcgcagctttacgccaccaacttggtcaacctgaccaagctgttaagcccgaacaaagacggcgaaatcacgctggacttcgaagacgtgattatccgcaacatgaccgttacccgcgacggcgaaatcaccttcccgcctccgccgattcaagtttccgcccaaccgcagcaaacgccgtctgaaaaagccgcgcctgccgccaagcccgaaccgaaacccgttcccctgtggaaaaaactcgcgcccgccntnatcgccgccgtgttggtactgtgggtcggcgcggtcgcacccgcagcattcctgaaccactttatcgtcttcgtcctcgcctgcgtcatcggctactatgtcgtttggaacgtcagccactcgctgcacacaccgctgatgtcggtgaccaacgccatttccggcatcatcgtcgtcggcgcgctgctgcaaatcggtcagggcaacggcttcgtttcgctgctgtcgtttgttgccatcctgattgccagcatcaacatcttcggcggcttctttgtaacgcggcggatgctgaatatgtttaggaaagggtaa

SEQ ID NO: 39475 - protein, 513 aa, Neisseria meningitidis
  misc_feature (129)..(129): Xaa can be any naturally occurring amino acid
  misc_feature (132)..(132): Xaa can be any naturally occurring amino acid
  misc_feature (152)..(152): Xaa can be any naturally occurring amino acid
  misc_feature (199)..(199): Xaa can be any naturally occurring amino acid
  misc_feature (267)..(269): Xaa can be any naturally occurring amino acid
  misc_feature (409)..(409): Xaa can be any naturally occurring amino acid
MKIGIPRESLSGETRVACTPATVALLGKLGFETVVESGAGLAASLDDAAYQAAGATVADKAAVWAYPLIYKVNAPSEDELPLLKEGQTIVSFLWPRQNEALVEALRAKKVNALAMDMVPRISRAQALDXLSXMANISGYRAVIEAANAFGRXFTGQITAAGKVPPAQVLVIGAGVAGLAAIGTANSLGAVVRVFDTRLXVAEQLESMGGKFLKLDFPQESGGSGDGYAKVMSDEFIAAEMKLFAEQAKEVDIIITTAAIPGKPAPKXXXKEMVESMKPGSVIVDLAAATGGNCELTKQGELFVTGNGVKIIGYTDMANRLAGQSSQLYATNLVNLTKLLSPNKDGEITLDFEDVIIRNMTVTRDGEITFPPPPIQVSAQPQQTPSEKAAPAAKPEPKPVPLWKKLAPAXIAAVLVLWVGAVAPAAFLNHFIVFVLACVIGYYVVWNVSHSLHTPLMSVTNAISGIIVVGALLQIGQGNGFVSLLSFVAILIASINIFGGFFVTRRMLNMFRKG

SEQ ID NO: 39476 - DNA, 384 bp, Neisseria gonorrhoeae
atgactttcgcctattggtgcattctgattgcctgcctattgccgcttttttgtgcggcgtatgccaaaaaagcgggcggattccggtttaaagacaaccacaatcctcgcggttttctggcacatacgcaaggcgcagccgcccgtgcccacgccgcgcagcaaaacggttttgaagcctttgcaccgtttgccgccgccgttttgacggcacacgcaaccggcaatgccggacaagcaaccgtcaacacgcttgccggattgttcatcctgttccgcctcgcctttatctggtgctacatcgcagacaaagcagcattgcgctcgctgatgtgggcgggcggatttgcctgcaccgtcggactgtttgtcgcggctgcttga

SEQ ID NO: 39477 - protein, 127 aa, Neisseria gonorrhoeae
MTFAYWCILIACLLPLFCAAYAKKAGGFRFKDNHNPRGFLAHTQGAAARAHAAQQNGFEAFAPFAAAVLTAHATGNAGQATVNTLAGLFILFRLAFIWCYIADKAALRSLMWAGGFACTVGLFVAAA

SEQ ID NO: 39478 - DNA, 384 bp, Neisseria meningitidis
atgactttcgcctattggtgtattctgattgcctgcctattgccgcttttttgtgcggcgtatgccaaaaaagcgggcggattccggtttaaagacaaccacaatccgcgcggttttctagcgcacacgcaaggcgcagccgcccgtgcccacgccgcacagcaaaacggttttgaagcctttgcaccgtttgccgccgccgttttgacggcacacgcaaccggcaatgcggcgcaatcgaccatcaacacgcttgcctgcctgttcatcctgttccgcctcgcctttatctggtgctatatcgccgacaaagccgctatgcgctcactgatgtgggcaggcggatttgcctgcaccgtcgggctgtttgtcgcggctgcttga

SEQ ID NO: 39479 - protein, 127 aa, Neisseria meningitidis
MTFAYWCILIACLLPLFCAAYAKKAGGFRFKDNHNPRGFLAHTQGAAARAHAAQQNGFEAFAPFAAAVLTAHATGNAAQSTINTLACLFILFRLAFIWCYIADKAAMRSLMWAGGFACTVGLFVAAA

SEQ ID NO: 39480 - DNA, 384 bp, Neisseria meningitidis
atgactttcgcctattggtgtattctgattgcctacctattgccgcttttttgtgcggcgtatgccaaaaaagcgggcggattccggtttaaagacaaccacaatccgcgcgattttctggcgcgcacgcaaggcacagccgcccgtgcccacgccgcgcagcaaaacggttttgaagcctttgcaccgtttgcagccgccgttttgacggcacacgcaaccggcaatgccggacaagcaaccgtcaacacgcttgccggcctgttcatcctgttccgcctcgcctttatctggtgctacatcgcagacaaagcagcattacgctcgctgatgtgggtgggcggatttgtctgcaccgtcgggctgtttgtcgtggctgcttga

SEQ ID NO: 39481 - protein, 127 aa, Neisseria meningitidis
MTFAYWCILIAYLLPLFCAAYAKKAGGFRFKDNHNPRDFLARTQGTAARAHAAQQNGFEAFAPFAAAVLTAHATGNAGQATVNTLAGLFILFRLAFIWCYIADKAALRSLMWVGGFVCTVGLFVVAA

SEQ ID NO: 39482 - DNA, 582 bp, Neisseria gonorrhoeae
atgaggaacgaggaaaaacgcgccctgcgccgcgaattgcgcgggcggcgttcgcaaatggggcgagacgtgcgggcggcggcggcgataaaaatcaaccgcctgctcaaacgttatatcaagcgcggtcggaaaatcggcgtgtattggccgatgggcaaggaattgcgtttgggcggctttgtccgcgcggcgcaaaaacgcggcgcaaaactctatctgccttatatcgaaccgcacacgcggcggatgtggtttacgccgtatcctgaacgcggaatggaacgggaacgcaagcgcggtagggcgaagctgcatgtccctcagtttgcagggcgcaaaatccgcgtgcacggtttgtcggtattgctcgtcccgcttgtcggcatagaccgcgaaggctaccgtttggggcaggcaggcggctattacgatgcgacgctttcggcgatgaaataccgtttgcaggcgaaaaccgtgggcgtgggctttgcctgccagttggtggacaggctcccacgcgaggcgcacgacctgccgctggacggttttgtatcggaagcggggatattgtgtttttag

SEQ ID NO: 39483 - protein, 193 aa, Neisseria gonorrhoeae
MRNEEKRALRRELRGRRSQMGRDVRAAAAIKINRLLKRYIKRGRKIGVYWPMGKELRLGGFVRAAQKRGAKLYLPYIEPHTRRMWFTPYPERGMERERKRGRAKLHVPQFAGRKIRVHGLSVLLVPLVGIDREGYRLGQAGGYYDATLSAMKYRLQAKTVGVGFACQLVDRLPREAHDLPLDGFVSEAGILCF

SEQ ID NO: 39484 - DNA, 582 bp, Neisseria meningitidis
atgaggaacgaggaaaaacgcgccctgcgccgcgaattgcgcgggcggcgttcgcaaatggggcgggacgtgcgggcggcggcaacggtaaaaatcaaccacctgctcaaacgttatattaaaaaagggcggaaaatcggcgtgtattggccgatgggcaaggaattgcgtttggacggctttgtccgcgcggcgcaaaaacgcggtgcggaactctacctgccttatatcgaaccgcgttcgcggcggatgtggtttacgccgtatcctgccgatggagtaaaacaagaacgcaagcgcggtagggcgaagctgcatgtccctcagtttgcaggtcggaaaaagcgtgtgcatgatttgaacctcctgcttgtgccagtggtcggtatggacaggctgggctaccgcttgggacaggcaggcggctattacgatgcgacgctttcagcgatgaaataccgtttgcaggcaaaaaccgtgggcgtgggctttgcctgccagttggtggacaggctgccggtcgaggcgcacgaccggtctttggacggttttgtgtcggaggcggggatattgtgtttttag

SEQ ID NO: 39485 - protein, 193 aa, Neisseria meningitidis
MRNEEKRALRRELRGRRSQMGRDVRAAATVKINHLLKRYIKKGRKIGVYWPMGKELRLDGFVRAAQKRGAELYLPYIEPRSRRMWFTPYPADGVKQERKRGRAKLHVPQFAGRKKRVHDLNLLLVPVVGMDRLGYRLGQAGGYYDATLSAMKYRLQAKTVGVGFACQLVDRLPVEAHDRSLDGFVSEAGILCF

SEQ ID NO: 39486 - DNA, 582 bp, Neisseria meningitidis
atgaggaacgaggaaaaacacgccttgcgccgagagttgcgccgcgcccgcgcgcagatggggcatcaagggcggttggcggcggggcaaacgattaaccgcctgctcaaacgttatatcaagcgtggtcggaaaatcggcgtgtattggccgatgggcaaggaattgcgtttggacggctttgtccgcgcggcgcaaaaacgcggtgcaaaactttatctgccttatatcgaaccgcgttcgcggcggatgtggtttacgccgtatcctgaaagcggaatggaacgggagcgcatacggggcagggcgaagttgaacgtgccgcagtttgcagggcgcaaaatccgcgtgcacggtttgtcggtattgctcgtcccgcttgtcggcatagaccgcgagggctaccgcttaggacaggcaggcggctattacgatgcgacgcttgcggcgatgaaataccgtttgcaggcaaaaaccgtgggcgtgggctttgcctgccagtttgtggacaggctgccgcgcgaaccgcacgatctgctgctggacggttttgtgtcggaggcggggatattgtgcttttag

SEQ ID NO: 39487 - protein, 193 aa, Neisseria meningitidis
MRNEEKHALRRELRRARAQMGHQGRLAAGQTINRLLKRYIKRGRKIGVYWPMGKELRLDGFVRAAQKRGAKLYLPYIEPRSRRMWFTPYPESGMERERIRGRAKLNVPQFAGRKIRVHGLSVLLVPLVGIDREGYRLGQAGGYYDATLAAMKYRLQAKTVGVGFACQFVDRLPREPHDLLLDGFVSEAGILCF

SEQ ID NO: 39488 - DNA, 912 bp, Neisseria gonorrhoeae
atgaaaaccaattcagaagaactgaccgtatttgttcaagtggtggaaagcggcagcttcagccgtgcggcggagcagttggagatggcaaattctgccgtaagccgcatcgtcaaacggctggaggaaaagttgggcgtgaacctgctcaaccgcaccacgcggcaactcaatctgacggaagaaggcgcgcaatatttccgccgcgcgcagagaatcctgcaagaaatggcagcggcggaaaccgaaatgctggcagtgcacgaagtaccgcaaggcgtgttgcgcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccacttccgcgtagtcgccagtcctgaatatttagcaaaacacggcacgccacaatctgcagaagatcttgccaaccatcaatgtttaggcttcacagaacccggttctctaaatacatgggcggttttagatgcgcagggaaatccctataaaatttcaccgcactttaccgccagcagcggtgaaatcttacgctcgttgtgcctttcaagttgcggtattgcttgcttatcagattttttggttgacaacgacatcactgaaggaaagttaattcccctattcgccgaacaaacctccaataaaacacacccctttaatgctgtttattacagcgataaagccgtcaacctccgcttacgcgtatttttggattttttagtgaaggaactgggaaaaaatatgaatagaacgaataccaaataa

SEQ ID NO: 39489 - protein, 303 aa, Neisseria gonorrhoeae
MKTNSEELTVFVQVVESGSFSRAAEQLEMANSAVSRIVKRLEEKLGVNLLNRTTRQLNLTEEGAQYFRRAQRILQEMAAAETEMLAVHEVPQGVLRVDSAMPMVLHLLAPLAAKFNERYPHIRLSLVSSEGYINLIERKVDIALRAGELDDSGLRARHLFDSHFRVVASPEYLAKHGTPQSAEDLANHQCLGFTEPGSLNTWAVLDAQGNPYKISPHFTASSGEILRSLCLSSCGIACLSDFLVDNDITEGKLIPLFAEQTSNKTHPFNAVYYSDKAVNLRLRVFLDFLVKELGKNMNRTNTK

SEQ ID NO: 39490 - DNA, 900 bp, Neisseria meningitidis
atgaaaaccaattcagaagaactgaccgtatttgttcaagtggtggaaagcggcagcttcagccgtgcggcggagcagttggcgatggcaaattctgccgtaagccgcatcgtcaaacggctggaggaaaagttgggtgtgaacctgctcaaccgcaccacgcggcaactcagtctgacggaagaaggcgcgcaatatttccgccgcgcgcagagaatcctgcaagaaatggcagcggcggaaaccgaaatgctggcagtgcacgaaataccgcaaggcgtgttgagcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctacagaagagcttgccggccaccaatgtttaggcttcaccgaacccggttctctaaatacatgggcggttttagatgcgcagggaaatccctataagatttcaccgcactttaccgccagcagcggtgaaatcttacgctcgttgtgcctttcaggttgcggtattgtttgcttatcagattttttggttgacaacgacatcgctgaaggaaagttaattcccctgctcgccgaacaaacctccgataaaacacacccctttaatgctgtttattacagcgataaagccgtcaatctccgcttacgcgtatttttggattttttagtggaggaactgggaaacaatctctgtggataa

SEQ ID NO: 39491 - protein, 299 aa, Neisseria meningitidis
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLSVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIVCLSDFLVDNDIAEGKLIPLLAEQTSDKTHPFNAVYYSDKAVNLRLRVFLDFLVEELGNNLCG

SEQ ID NO: 39492 - DNA, 900 bp, Neisseria meningitidis
atgaaaaccaattcagaagaactgaccgtatttgttcaagtggtggaaagcggcagcttcagccgtgcggcggagcagttggcgatggcaaattctgccgtaagccgcatcgtcaaacggctggaggaaaagttgggtgtgaacctgctcaaccgcaccacgcggcaactcagtctgacggaagaaggcgcgcaatatttccgccgcgcgcagagaatcctgcaagaaatggcagcggcggaaaccgaaatgctggcagtgcacgaaataccgcaaggcgtgttgcgcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctacagaagagcttgccggccaccaatgtttaggcttcaccgaacccggttctctaaatacatgggcggttttagatgcgcagggaaatccctataagatttcaccgcactttaccgccagcagcggtgaaatcttacgctcgttgtgcctttcaggttgcggtattgcttgcttatcagattttttggttgacaacgacatcgctgaaggaaagttaattcccctgctcgccgaacaaacctccaataaaacgcacccctttaatgctgtttattacagcgataaagccgtcaacctccgcttacgcgtatttttggattttttagtggaggaactgggaaacaatctctgtggataa

SEQ ID NO: 39493 - protein, 299 aa, Neisseria meningitidis
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLRVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIACLSDFLVDNDIAEGKLIPLLAEQTSNKTHPFNAVYYSDKAVNLRLRVFLDFLVEELGNNLCG

SEQ ID NO: 39494 - DNA, 897 bp, Neisseria gonorrhoeae
atggacattctggacaaactggtcgatctcgcccaattgacgggcagtgcggatgtgcagtgccttttgggcggacaatggcatgaaaccttgcaacgcgaagggctggtacacattgttacggcgggcagcggttatctctgcatcgacggcgaaacttccccgcgtccggtcggcacgggcgatattgtatttttcccgcgcggcttgggtcatgtgttgagccacgacggaaaatacggagaaagtttacaaccggacatacgacaaaacggcacatttatggtcaaacagtgcggcaacgggctggatatgagcctgttttgcgcccgtttccgctacgacacccacgccgatttgatgaacgggctgccggaaaccgtttttctgaacattgcccatccaagtttgcagtatgtggtttcaatgctgcaactggaaagcgaaaaacctttgacggggacggtttccgtggtcaacgcattaccgtccgtcctgctggtgcttatcctgcgcgcctatctcgaacaggataaggatgtcgaactctcgggcgtattgaaaggttggcaggacaaacgtttgggacatttgatccaaaaggtgatagacaaaccggaagacgaatggaatattgacaaaatggttgccgccgccaatatgtcgcgcgcgcaactgatgcgccgcttcaaaagccaagtcggactcagcccgcacgcctttgtgaaccatatccgcctgcaaaaaggcgcattgctgctgaagaaaaccccggattcggttttggaggtcgcgctgtcggtgggctttcagtcggaaacgcatttcggcaaggcgttcaaacggcaatatcacgtttcgccggggcaataccggaaagaaggcgggcaaaaataa

SEQ ID NO: 39495 - protein, 298 aa, Neisseria gonorrhoeae
MDILDKLVDLAQLTGSADVQCLLGGQWHETLQREGLVHIVTAGSGYLCIDGETSPRPVGTGDIVFFPRGLGHVLSHDGKYGESLQPDIRQNGTFMVKQCGNGLDMSLFCARFRYDTHADLMNGLPETVFLNIAHPSLQYVVSMLQLESEKPLTGTVSVVNALPSVLLVLILRAYLEQDKDVELSGVLKGWQDKRLGHLIQKVIDKPEDEWNIDKMVAAANMSRAQLMRRFKSQVGLSPHAFVNHIRLQKGALLLKKTPDSVLEVALSVGFQSETHFGKAFKRQYHVSPGQYRKEGGQK

SEQ ID NO: 39496 - DNA, 906 bp, Neisseria meningitidis
atggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaaggcgggcaaaaataa

SEQ ID NO: 39497 - protein, 301 aa, Neisseria meningitidis
MDILDKLVDFAQLTGSVDVQCLLGGQWSVRHETLQREGLVHIVTSGSGYLCIDGETSPRPVSTGDIVFFPRGLGHVLSHDGKCGESLQPDMRQHGAFTVKQCGNGQDMSLFCARFRYDTHADLMNGLPETVFLNIAHPSLQYVVSMLQLESKKPLTGTVSMVNALSSVLLVLILRAYLEQDKDVELSGVLKGWQDKRLGHLIQKVIDKPEDEWNVDKMVAAANMSRAQLMRRFKSRVGLSPHAFVNHIRLQKGALLLKKNPDSVLSVALSVGFQSETHFGKAFKRQYHVSPGQYRKEGGQK

SEQ ID NO: 39498 - DNA, 906 bp, Neisseria meningitidis; identical to SEQ ID NO: 39496

SEQ ID NO: 39499 - protein, 301 aa, Neisseria meningitidis; identical to SEQ ID NO: 39497

SEQ ID NO: 39500 - DNA, 903 bp, Neisseria gonorrhoeae
atggataccgcaaaaaaagacattttaggatcgggctggatgctggtggcggcggcctgcttcaccgttatgaacgtattgattaaagaggcatcggcaaaatttgccctcggcagcggcgaattggtcttttggcgcatgctgttttcaaccgttacgctcggtgctgccgccgtattgcggcgcgacaccttccgcacgccccattggaaaaaccacttaaaccgcagtatggtcgggacgggggcgatgctgctgctgttttacgcggtaacgcatctgcctttgacaaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaccggcggcactcgccgggctggcgggcggcgcgatgtccggctgggcgtatttgaaagtgcgcgaactgtctttggcgggcgaacccggctggcgcgtcgtgttttacctttccgcaaccggcgtggcgatgtcgtcggtttgggcgacgctgaccggctggcacaccctgtcctttccatcggcagtttatctgtcgggcatcggcgtgtccgcgctgattgcccaactgtcgatgacgcgcgcctacaaagtcggcgacaaattcacggttgcctcgctttcctatatgaccgtcgtcttttccgccctgtctgccgcattttttctgggcgaagagcttttctggcaggaaatactcggtatgtgcatcattatcctcagcggcattttgagcagcatccgccccattgccttcaaacagcggctgcaagccctcttccgccaaagataa

SEQ ID NO: 39501 - protein, 300 aa, Neisseria gonorrhoeae
MDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 39502 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataa

SEQ ID NO: 39503 - protein, 300 aa, Neisseria meningitidis
  misc_feature (64)..(64): Xaa can be any naturally occurring amino acid
MDTAKKDILGSGWMLVAAACFTIMNVLIKEASAKFALGSGELVFWRMLFSTVALGAAAVLRRDXFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 39504 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcatcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctggccgaagagcttttctggcaggaaatactcggtatgtgcatcatcatcctcagcggtattttgagcagcatccgccccactgccttcaaacagcggctgcaatccctgttccgccaaagataa

SEQ ID NO: 39505 - protein, 300 aa, Neisseria meningitidis
MDTAKKDILGSGWMLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLAEELFWQEILGMCIIILSGILSSIRPTAFKQRLQSLFRQR

SEQ ID NO: 39506 - DNA, 1983 bp, Neisseria gonorrhoeae
atggttattttgacgactttgttttttgtgtgtgttttggtggtattggttttaaccgtgccggatcaggtgcagatgtggctcgaccgggcaaaagaagtcatttttaccgagttcagctggttttatgttttaacgttttccatttttctgggttttctgctgatactctcggtcagcggtttgggaaacatcaggctaggacgggatgaagatgtgccggaattcggcttcctgtcgtggctggcgatgctgtttgcggccgggatgggcgtgggcctgatgtttttcggcgtggcagagccgttgatgcattatttttcggacattacggtcggcgcgccggaacacaggcagcagcaggcattgctgcacacggtgttccattggggcgttcacgcctggtcggtgtacggtacgattgcattggctttggcttatttcggtttccgctacaaactgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcggcgtgcaggtcttgattatcgccgccgtaatgtccctcgccgtcgtttcggcaatatccggcgtggggaagggcgtgaaggtgttgagcgagttgaacctgggccttgcgtttttgctgctgttttttgttttggcggcggaccccactgtttacctgttgtcggcattcggcgacaacatagggaactacctcggaaatctggtgcgcctcagtttgaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaactgacgagcatcgtcagcctgctggtcatttccctgttttttgtaacttctgccgactccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggtcaaccctaccagtgtattttggacgggcggcaagtggaaagaacggctggtgcggataatgagccagacgcaggagcaggatattttaaaattcctcaaacataccgcatcgcccgctatgcacgagttgcaacgggagctttcggaagaatacggcttgagcgtccgggtcgataagatgtttcatcaggacgagcccgcaatcgagttcgtcattcggaaagagacgatgcgcgattttatgtacgggattaagtctgtcgggcaggatgtatccgaccagttgattaacgacggcaagctgccgcatatccggcaccagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 39507 - protein, 660 aa, Neisseria gonorrhoeae
MVILTTLFFVCVLVVLVLTVPDQVQMWLDRAKEVIFTEFSWFYVLTFSIFLGFLLILSVSGLGNIRLGRDEDVPEFGFLSWLAMLFAAGMGVGLMFFGVAEPLMHYFSDITVGAPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFGVQVLIIAAVMSLAVVSAISGVGKGVKVLSELNLGLAFLLLFFVLAADPTVYLLSAFGDNIGNYLGNLVRLSLKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVRIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 39508 - DNA, 1983 bp, Neisseria meningitidis
atggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcagcgtgcaggttttgattatcgccgccgtcatgtccctcgccgtcgtttcggcaatatccggcgtggggaagggcgtgaaggtgttgagcgagttgaacctgggccttgcgtttttgctgctgttttttgttttggcggcgggacccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggttaaccctaccagtgtattttggacgggcggcaagtggaaagaacggctggtgcagataatgagccagacgcaggagcaggatattttaaaattcctcaaacagactgcatcgcccgctatgcacgagttgcaacgggagctttcggaagaatacggcttgagcgtccgggtcgataaaatgtttcatcgggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 39509 - protein, 660 aa, Neisseria meningitidis
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKQTASPAMHELQRELSEEYGLSVRVDKMFHRDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 39510 - DNA, 1983 bp, Neisseria meningitidis
atggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaataggctggattgccgaaaacagcttcagcgtgcaggttttgattatcgccgccgtcatgtccctcgccgtcgtttcggcaatatccggcgtggggaagggtgtgaaggtgttgagcgagttgaacctgggtcttgcgtttttgctgctgttttttgttttggcggcgggtcccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggagtgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggattgagtgcggataagaaatattttgagacccgggttaaccctaccagtgtattttggacgggcggcaagtggaaagaacggctggtgcagataatgagccagacgcaggagcaggatattttaaaattcctcaaacataccgcatcgcccgctatgcacgagttacaacgggagctttcggaagaatacggcttgagcgtccgggtcgataagatgtttcatcaggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 39511 - protein, 660 aa, Neisseria meningitidis
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEIGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGVLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 39512 - DNA, 1299 bp, Neisseria gonorrhoeae
atgaacacatttttgaaaaacagcgaatacgcgtatatcctgaacgactgcaaggcgcgcttcctgttcgcctcggccggcctgtcaaaagaattggcgggcctgaaggcgcaaacgcccgtcgaaaaaatcatttggacggacaaaagccggccggccggcgaaacggcggaaggcgatgccttttttgaaaacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaaacgcgaccgctttatcgttttcctgccgatgttccacagcttcacgctgacggctatggtgctgctgccgatttatatggcgtgttcgattattttggtcaaatccgttttccccttttccaacgttttgaaacaggccctgctcaaacgcgcaaccgtgtttttgggcgtacccgcgatttacaccgcgatgagcaaggcaaaaatcccttggtatttcagatggttcaaccgcatccgcctgtttatcagcggcggcgcgcctttggcggaacaaaccatcctcgattttaaagccaagttcccccgcgccaaattgctggaaggctacggactgagcgaagcctcgcccgtcgtcgccgtcaatacgcccgaacggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaggacggctttatctttatcgtcgaccgcaaaaaagatttgattatttccaaaggtcaaaacgtctatccgcgcgagatcgaagaagaaatccacaaactcgatgccgtcgaagccgccgccgtcatcggcgtgaaagaccgttatgccgacgaggaaatcgtcgccttcgtccaattgaaggaaggtatggatttgggcgaggacgaaatccgccgccacctgcgtaccgtgctggcaaatttcaaaatccccaaacagatccactttaaagacgggctgccgcgcaacgctacgggcaaagtattgaaacgggtgctgaaggagcagtttgaaggaaacaaatga

SEQ ID NO: 39513 - protein, 432 aa, Neisseria gonorrhoeae
MNTFLKNSEYAYILNDCKARFLFASAGLSKELAGLKAQTPVEKIIWTDKSRPAGETAEGDAFFENVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIHKLDAVEAAAVIGVKDRYADEEIVAFVQLKEGMDLGEDEIRRHLRTVLANFKIPKQIHFKDGLPRNATGKVLKRVLKEQFEGNK

SEQ ID NO: 39514 - DNA, 1554 bp, Neisseria meningitidis
atgaaccggacttatgccaatttctacgaaatgctcgccgccgcctgccgcaaaaacggaaacggcacggcagtgttcgacggcaaggaaaaaaccgcctaccgcgcgctcaagcaggaggccgaagccgtcgcggcgtatctgcaaaatatcggcgtgaagttcggcgacacggtcgcgctggcggtttccaattccacagaatttattaccgcctatttcgccatctccgccatcggcgcggtcgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacggacaaaagccgtccgaccggcgaaacggcggaaggcgatgccttttttgaagacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaagcgcgaccgctttatcgttttcctgccgatgttccacagcttcacgctgacggctatggtgctgctgccgatttatatggcgtgttcgattattttggtcaaatccgtttttccgttttccaacgttttgaaacagacactgctcaaacgcgcgaccgtgtttttgggcgtacccgcgatttacaccgcgatgagcaaggcgaaaatcccttggtatttcagatggttcaaccgcattcgcctgtttatcagcggcggcgcgcctttggcggaacaaaccatcctcgatttcaaagccaagttcccccgcgccaaattgctggaaggctacggactgagcgaagcctctcccgtcgtcgccgtcaatacgcccgagaggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgagattgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatga

SEQ ID NO: 39515 - protein, 517 aa, Neisseria meningitidis
MNRTYANFYEMLAAACRKNGNGTAVFDGKEKTAYRALKQEAEAVAAYLQNIGVKFGDTVALAVSNSTEFITAYFAISAIGAVAVPMNTFLKNSEYAYILNDCKARFLFASAGLSKELAGLKAQTPVEKIIWTDKSRPTGETAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQTLLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 39516 - DNA, 1554 bp, Neisseria meningitidis
atgaaccggacttatgccaatttctacgaaatgctgaccgccgcctgccgcaaaaacggcaacggcacggcagtgttcgacggcaaggaaaaaaccgcctaccgcgcgctcaagcaggaagccgaagccgttgcggcgtatctgcaaaatatcggcgtgaagttcggcgacacggtcgcgctggcggtttccaattccacggaatttattaccgcctatttcgccgtatccgccatcggcgcggttgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacgggccaaagccgtccggacggcgaaatggcggaaggcgatgccttttttgaagacgtgcgccgcttccccgaaaaacccgacttgggccgccaaccccggataaatgatttggcacacatcatctacacctccggcacgacggggcatcccaaaggtgcgctaatcagctacgccaacctgttcgccaacctgaacggcatcgaacgcatctttaaaatctccaagcgcgaccgctttatcgttttcctgccgatgttccacagcttcacgctgacggctatggtgctgctgccgatttatatggcgtgttcgattattttggtcaaatccgttttccccttttccaacgttttgaaacaggcactgctcaaacgcgcgaccgtgtttttgggcgtgcccgcgatttacaccgcgatgagcaagacgaaaatcccttggtatttcagatggttcaaccgcatccgcctgtttatcagcggcggagcacctttggcggaacaaaccatcctcgatttcaaagccaagttcccccgcgccaaattgctggaaggctacggactgagcgaagcctcgcccgtcgtcgccgtcaatacgcccgagaggcaaaaagcccgcagcgtcggcatccccctgcccggtttggaagtcaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgaaatcgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatga

SEQ ID NO: 39517 - protein, 517 aa, Neisseria meningitidis
MNRTYANFYEMLTAACRKNGNGTAVFDGKEKTAYRALKQEAEAVAAYLQNIGVKFGDTVALAVSNSTEFITAYFAVSAIGAVAVPMNTFLKNSEYAYILNDCKARFLFASAGLSKELAGLKAQTPVEKIIWTGQSRPDGEMAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKTKIPWYFRWFNRIRLFISGGAPLAEQTILDFKAKFPRAKLLEGYGLSEASPVVAVNTPERQKARSVGIPLPGLEVKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 39518 - DNA, 1092 bp, Neisseria gonorrhoeae
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgctgggtgcggacggcgtcatcaatccggcgcgcgccctgaatattgccgaacagtttcatgtcagccgccagttttgggcgacgctggtcgcggaaggcaagttggaagacaattccttcatcaatgccgtgccgcatatgtctttggtgatgaacgaagaccactgccgttacctgcaaaaacgctatgatgtgtttaaaacgcagaaactttttgaaaatatggaattttccaccgatcggaacaaaatttccgattgggctccgctgattatgcgcggccgggacgaaaaccaacccgtcgccgccaactattccgccgaaggcacggatgtcgatttcggacggctgacgcgccagatggtgaaatatttgcagggcaagggcgtaaaaaccgagttcaaccgccacgtcgaagacatcaaacgcgaatccgacggcgcgtgggtgctcaaaaccgccgatacccgcaacccagactggcagctcaccctccgcacccgcttcctcttcctcggcgcgggcggcggcgcactgaccctgctgcaaaaatccggcatccccgaaggcaaaggctacggcggcttacccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtagacggcaaacgacaccttatgttcggtccttacgcaggtttccgttccaacttcctcaagcaaggctcgtttatggatttgccgctgtccatccatatggacaacctctatcctatgctgcgcgccggctgggcgaatatgccgctgaccaaatacctgctgggcgaattgcgttaa

SEQ ID NO: 39519 - protein, 363 aa, Neisseria gonorrhoeae
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELR

SEQ ID NO: 39520 - DNA, 1068 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgctggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggtacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggcggcttccccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcgcttatggatttgccgctgtccatccatatggacaacctctatcctatgctgtgcgccggctgggcgaatatgccgctgaccaaa

SEQ ID NO: 39521 - protein, 356 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTK

SEQ ID NO: 39522 - DNA, 1467 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgttggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggcacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggtggctttcccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcacttatggatttgccgctgtccatccatatggacaacctctatcctatgctgcgcgccggctgggcgaatatgccgctgaccaaatacctgctgggcgaattgcgtaaaaccaaagaagaacgcttcgcctccctgctggaatactaccccgaggcaaaccccgacgactgggaactcatcaccgcagggcaacgcgttcaaatcattaaaaaagactccgaaaaaggcggcgtgttgcagtttggtacggagattgtcgcacacgccgacggctcgctcgccgcattgctgggcgcgtcgccgggcgcatcgaccgccgtgccgctgatgatccggctgatgcaccaatgcttccccgaacgcaccccgtcttgggaaggccgtctgaaagagctggtaccgggttacggcatcaagttgaacgaaaaccccgaaagggcggatgaaattatcgcctataccgcgaaagtgttggatatttaa

SEQ ID NO: 39523 - protein, 488 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLRAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERTPSWEGRLKELVPGYGIKLNENPERADEIIAYTAKVLDI

SEQ ID NO: 39524 - DNA, 1338 bp, Neisseria gonorrhoeae
  misc_feature (1169)..(1169): n is a, c, g, or t
  misc_feature (1187)..(1187): n is a, c, g, or t
  misc_feature (1280)..(1280): n is a, c, g, or t
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgctgggtgcggacggcgtcatcaatccggcgcgcgccctgaatattgccgaacagtttcatgtcagccgccagttttgggcgacgctggtcgcggaaggcaagttggaagacaattccttcatcaatgccgtgccgcatatgtctttggtgatgaacgaagaccactgccgttacctgcaaaaacgctatgatgtgtttaaaacgcagaaactttttgaaaatatggaattttccaccgatcggaacaaaatttccgattgggctccgctgattatgcgcggccgggacgaaaaccaacccgtcgccgccaactattccgccgaaggcacggatgtcgatttcggacggctgacgcgccagatggtgaaatatttgcagggcaagggcgtaaaaaccgagttcaaccgccacgtcgaagacatcaaacgcgaatccgacggcgcgtgggtgctcaaaaccgccgatacccgcaacccagactggcagctcaccctccgcacccgcttcctcttcctcggcgcgggcggcggcgcactgaccctgctgcaaaaatccggcatccccgaaggcaaaggctacggcggcttacccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtagacggcaaacgacaccttatgttcggtccttacgcaggtttccgttccaacttcctcaagcaaggctcgtttatggatttgccgctgtccatccatatggacaacctctatcctatgctgcgcgccggctgggcgaatatgccgctgaccaaatacctgctgggcgaattgcgtaaaaccaaagaagaacgctttgcctccctgctggaatactacccgaggcagacccgacgactggtactcatcacgcaggncacgcgtcatatcattanatatgactcgaaactgcgcgtgctgcagttgtacgagattgtgccacgcgacgctcgctcgcgcattctggagcgtcgcggcgcatcacgctntgcgctgatatccgctgatgacactgctccgagcgcgcccgtcttggaaagtgtctga

SEQ ID NO: 39525 - protein, 445 aa, Neisseria gonorrhoeae
  misc_feature (390)..(390): Xaa can be any naturally occurring amino acid
  misc_feature (396)..(396): Xaa can be any naturally occurring amino acid
  misc_feature (427)..(427): Xaa can be any naturally occurring amino acid
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELRKTKEERFASLLEYYPRQTRRLVLITQXTRHIIXYDSKLRVLQLYEIVPRDARSRILERRGASRXALISADDTAPSAPVLESV

SEQ ID NO: 39526 - DNA, 1467 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgctggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggtacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggcggcttccccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcgcttatggatttgccgctgtccatccatatggacaacctctatcctatgctgtgcgccggctgggcgaatatgccgctgaccaaatacctgctgggcgaattgcgtaaaaccaaagaagaacgcttcgcctccctgctggaatactaccccgaggcaaaccccgacgactgggaactcatcaccgcagggcaacgcgtccaaatcattaaaaaagactccgaaaaaggcggcgtgctccagtttggtacggagattgtcgcccacgccgacggctcactcgccgcattgctgggcgcgtcgccgggcgcatcgaccgctgtgccgctgatgatccggctgatgcaccaatgcttccccgagcgcgccccgtcttgggaagaccgtctgaaagagctggtaccgggttacggcatcaagttgaacgaaaaccctgaaagggcggatgaaattatcgcctataccgcgaaagtattggatatttaa

SEQ ID NO: 39527 - protein, 488 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERAPSWEDRLKELVPGYGIKLNENPERADEIIAYTAKVLDI

SEQ ID NO: 39528 - DNA, 1467 bp, Neisseria meningitidis; identical to SEQ ID NO: 39522

SEQ ID NO: 39529 - protein, 488 aa, Neisseria meningitidis; identical to SEQ ID NO: 39523

SEQ ID NO: 39530 - DNA, 753 bp, Neisseria gonorrhoeae
atggcggcggcggaaataaaacgccccctcgctgtcgatttccagcacatagcgtccgttctgcacggcggcatagccgcttttgcctgcctgatagggttgcagggcggaatgcgaaatcaggtaatcagtcagtttgccgccgtcttcggcgatattgcccaccagtttggcaaacaaggtatggcacacgccgttttccgcccagcccgaaggcgcgtcctttccgtcggtttccatacatttgccgacgacggcttccaagtcgttgggatgctttccggtcagccggacggcgttttgttccggcaagcctttaatcggataactgatttgttttttgccgtcgttggttttgccttcgctactttgtcccaaagccaaaccggcaatcgccgtattgtcgatgtatttgactttgaaaaccggtttcggcgcgctttgtgccgcattttgcggctgttccgccgtattttcggatttgccgcaggcggcaagcagcaggcagccgcccaacacggcaaaaggtattttcagcattccgcactcctgatggtttcaaaatgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtag

SEQ ID NO: 39531 - protein, 250 aa, Neisseria gonorrhoeae
MAAAEIKRPLAVDFQHIASVLHGGIAAFACLIGLQGGMRNQVISQFAAVFGDIAHQFGKQGMAHAVFRPARRRVLSVGFHTFADDGFQVVGMLSGQPDGVLFRQAFNRITDLFFAVVGFAFATLSQSQTGNRRIVDVFDFENRFRRALCRILRLFRRIFGFAAGGKQQAAAQHGKRYFQHSALLMVSKCRLKCRLKRGRRRFGRHWVYFNGRMPTASRTLSNNSRASLRAFCAPACKISSICEGLEVNAL

SEQ ID NO: 39532 - DNA, 739 bp, Neisseria meningitidis
atggcggcggcggaaataaaacgccccttcgctgtcgatttccagcacatagcgtccgttctgcacggcggcatagccgcttttgcctgcctgatagggttgcagggcggcatgcgaaactaggtaatccgtcagtttgccgccgtcttcggcgatattgcccaccagtttggcaaacaaggtatggcacacgccgttttctgcccaacctgccggactgtccttatcatcggtttccatacatttgccgctgacggcttccaagtcgccgggatgcttgccgatcagtcggataacattttgttccggcaagcctttaatcggataactgatttgttttttgccgtcgttggttttgccttcgctgctttgtcccaaatccaaaccggcaatcgccgtattgtcgatatatatgactttgaaaaccggtttcggcgcgctttgtaccgcgttttgcggctgtaccgccgtatttwcggatttgccgcacggcaargcagcaggcagccgcccaatacggcaaaarawgtwttcagcattccacaytcctgatggtttcaaaatgccgtctgaaacgcggcaggcggaggttcggacggcatcgggttcatttcaacgggcggatgccgaccgcatcggtactttgtccaataattcgcgtgcttctttacgcgctttcgccgcgcctgcctgcaaaatctcttcgatttgcgaagggtcggcggtcagctcgttgtag

SEQ ID NO: 39533 - protein, 245 aa, Neisseria meningitidis
  misc_feature (158)..(158): Xaa can be any naturally occurring amino acid
  misc_feature (165)..(165): Xaa can be any naturally occurring amino acid
  misc_feature (175)..(177): Xaa can be any naturally occurring amino acid
  misc_feature (182)..(182): Xaa can be any naturally occurring amino acid
MAAAEIKRPFAVDFQHIASVLHGGIAAFACLIGLQGGMRNVIRQFAAVFGDIAHQFGKQGMAHAVFCPTCRTVLIIGFHTFAADGFQVAGMLADQSDNILFRQAFNRITDLFFAVVGFAFAALSQIQTGNRRIVDIYDFENRFRRALYRVLRLYRRIXGFAATAXQQAAAQYGKXXXQHSTXLMVSKCRLKRGRRRFGRHRVHFNGRMPTASGTLSNNSRASLRAFAAPACKISSICEGSAVSSL

SEQ ID NO: 39534 - DNA, 474 bp, Neisseria meningitidis
atggcggcggcggaaataaaacgccccctcgctgtcgatttccagcacatagcgtccgttctgcacggcggcatagccgcttttgcctgcctgatagggttgcagggcggaatgcgaaatcaggtaatccgtcagtttgccgccgtcttcggcgatattgcccaccagtttggcaaacaaggtatggcacacgccgtttgccgcccagcccgaaggcgcgccctttccgtcggtttccatacatttgccgacgacggcttccaagtcgttgggatgcttgccggtcagccggacgacgttttgttccggcaagcctttaagaggttcggacggcattgggtttatttcaacgggcggataccgaccgcatcacgtactttgcccaataattcgcgtgcttctttacgcgctttttgcgcgcctgcctgcaaaatctcttcgatttgcgaagggtcggcggtcagctcgttgtag

SEQ ID NO: 39535 - protein, 157 aa, Neisseria meningitidis
MAAAEIKRPLAVDFQHIASVLHGGIAAFACLIGLQGGMRNQVIRQFAAVFGDIAHQFGKQGMAHAVCRPARRRALSVGFHTFADDGFQVVGMLAGQPDDVLFRQAFKRFGRHWVYFNGRIPTASRTLPNNSRASLRAFCAPACKISSICEGSAVSSL

SEQ ID NO: 39536 - DNA, 546 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 39537 - protein, 181 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 39538 - DNA, 545 bp, Neisseria meningitidis
atgctgaawacwtyttttgccgtattgggcggctgcctgctgcyttgccgtgcggcaaatccgwaaatacggcggtacagccgcaaaacgcggtacaaagcgcgccgaaaccggttttcaaagtcatatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 39539 - protein, 181 aa, Neisseria meningitidis
  misc_feature (3)..(3): Xaa can be any naturally occurring amino acid
  misc_feature (5)..(5): Xaa can be any naturally occurring amino acid
  misc_feature (15)..(15): Xaa can be any naturally occurring amino acid
  misc_feature (22)..(22): Xaa can be any naturally occurring amino acid
MLXTXFAVLGGCLLXCRCGKSXNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 39540 - DNA, 336 bp, Neisseria meningitidis
tccgaacctcttaaaggcttgccggaacaaaacgtcgtccggctgaccggcaagcatcccaacgacttggaagccgtcgtcggcaaatgtatggaaaccgacggaaagggcgcgccttcgggctgggcggcaaacggcgtgtgccataccttgtttgccaaactggtgggcaatatcgccgaagacggcggcaaactgacggattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 39541 - protein, 111 aa, Neisseria meningitidis
SEPLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 39542 - DNA, 524 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgtttta

SEQ ID NO: 39543 - protein, 174 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAF

SEQ ID NO: 39544 - DNA, 546 bp, Neisseria meningitidis
atgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 39545 - protein, 181 aa, Neisseria meningitidis
MLKTSFAVLGGCLLLAACGKSENTAEQPQNAVQSAPKPVFKVKYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 39546 - DNA, 330 bp, Neisseria meningitidis
cctcttaaaggcttgccggaacaaaacgtcgtccggctgaccggcaagcatcccaacgacttggaagccgtcgtcggcaaatgtatggaaaccgacggaaagggcgcgccttcgggctgggcggcaaacggcgtgtgccataccttgtttgccaaactggtgggcaatatcgccgaagacggcggcaaactgacggattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 39547 - protein, 109 aa, Neisseria meningitidis
PLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 39548 - DNA, 534 bp, Neisseria gonorrhoeae; identical to SEQ ID NO: 38789

SEQ ID NO: 39549 - protein, 177 aa, Neisseria gonorrhoeae; identical to SEQ ID NO: 38790

SEQ ID NO: 39550 - DNA, 534 bp, Neisseria meningitidis; identical to SEQ ID NO: 38787

SEQ ID NO: 39551 - protein, 177 aa, Neisseria meningitidis; identical to SEQ ID NO: 38788
  misc_feature (116)..(116): Xaa can be any naturally occurring amino acid

SEQ ID NO: 39552 - DNA, 534 bp, Neisseria meningitidis; identical to SEQ ID NO: 38791

SEQ ID NO: 39553 - protein, 177 aa, Neisseria meningitidis; identical to SEQ ID NO: 38792

SEQ ID NO: 39554 - DNA, 780 bp, Neisseria gonorrhoeae
atgctgcggcatttaggaaacgacttcgccttgggcgcgttgtttttcgatgctgcggttgatgtgccactgctgggcgatggtcaggaggttgttgaccacccagtagagaaccaaaccggcagggaagaagaagaacatgacggagaaaaccaacggcatgattttcatcattttcgcctgcatcgggtcggtcggcggcgggttcagataggtttgggcgaacatcgttgccgccataatgatgggcaggatgtagtaggggtcggcgcggctgaggtcggtaatccagcccagccaaggtgcctggcgcaattctacggaggcgaacaatgcccagtacaagccgatgaagacggggatttgcaacagcataggcagacagccgcccagcgggttgatttcctcgtcttcgaaaagctgcatcatcgcttgctgttgcgccatacggtcgtcgccgtatttttctttgatggtctgcagttcgggtgcggcggcacgcattttcgccatcgaacggtaggaggcgttggtcaatggatacagtacggctttgacgatgatggtcaaaacgacgattgcccagccccagttgccgataatgttgtgcagttggttcaggagccagaagagcggcgatgcgaaccagtgtactttaccgtagtcttttgccagttgcaggttgtcggcgatgtttgcgataacggatgtggtttgcggaccggcatacaggttgaccgccattttcggttttggcccccgggttgggatagcggttaa

SEQ ID NO: 39555 - protein, 259 aa, Neisseria gonorrhoeae
MLRHLGNDFALGALFFDAAVDVPLLGDGQEVVDHPVENQTGREEEEHDGENQRHDFHHFRLHRVGRRRVQIGLGEHRCRHNDGQDVVGVGAAEVGNPAQPRCLAQFYGGEQCPVQADEDGDLQQHRQTAAQRVDFLVFEKLHHRLLLRHTVVAVFFFDGLQFGCGGTHFRHRTVGGVGQWIQYGFDDDGQNDDCPAPVADNVVQLVQEPEERRCEPVYFTVVFCQLQVVGDVCDNGCGLRTGIQVDRHFRFWPPGWDSG

SEQ ID NO: 39556 - DNA, 1025 bp, Neisseria meningitidis
atgctgcggcatttaggaaacgacttcgccttggggcgttgtttttcgatgctgcggttgatgtgccattgctgggcgatggtcaggaggttgttgactacccagtacaataccagaccggcagggaagaagaagaacatgacggagaaaaccaacggcatgattttcatcattttcgcctgcatcgggtcggtcggcggcgggttcagataagtttgggcgaacatcgttgccgccataatgatgggcaggatgtagtaggggtcggcgcggctgaggtcggtaatccaacccagccaaggtgcctggcgcaattctacggaggcgaacaatgcccaatacaatccgatgaagacggggatttgcaacagcataggcaggcagccgcccagcgggttgattttctcgtctgtgtaaagctgcatcatcgcctgttgttgcgccatacggtcgtcgccgtatttctctttgatggcttgcagtttgggtgcggcggcacgcattttcgccatagagcggtaagaggcgttggtcaatggatacagtacggctttgacgatgatggttaaaacgataatcgcccagccccagttgccgatgatgttgtgcagttggttcaggagccagaagagcggggaggcgaaccagtgtactttgccgtagtctttggccagttgcaggttgtcggcgatgtttgcgatgacggatgtggtctgcgggccggcgtagaggttgatggaggcttcggtttcgcgccgttttggatggcggctaaaggcacgctgacgctggtgctgtacagcttgtcgttgcggcgtttgatgtcgatgttgcactcgcctgcggcgcaaacgctttgtctgcctttaggttggagaatccaggtggacatgaagtggtgttcaatcatgccgagccagccggtcggggttttgcggatgtattcggcctcggatttgccggatttggcatcgtcgtccaagtcggaaaagctgactttttggaagttgccttcaggggtataa

SEQ ID NO: 39557 - protein, 340 aa, Neisseria meningitidis
MLRHLGNDFALGALFFDAAVDVPLLGDGQEVVDYPVQYQTGREEEEHDGENQRHDFHHFRLHRVGRRRVQISLGEHRCRHNDGQDVVGVGAAEVGNPTQPRCLAQFYGGEQCPIQSDEDGDLQQHRQAAAQRVDFLVCVKLHHRLLLRHTVVAVFLFDGLQFGCGGTHFRHRAVRGVGQWIQYGFDDDGNDNRPAPVADDVVQLVQEPEERGGEPVYFAVVFGQLQVVGDVCDDGCGLRAGVEVDGGFGFAPFWMAAKGTLTLVLYSLSLRRLMSMLHSPAAQTLCLPLGWRIQVDMKWCSIMPSQPVGVLRMYSASDLPDLASSSKSEKLTFWKLPSGV

SEQ ID NO: 39558 - DNA, 1026 bp, Neisseria meningitidis
atgctgcggcatttaggaaacgacttcgccttgggcgcgttgtttttcgatgctgcggttgatgtgccattgctgggcgatggtcaggaggttgttgatcacccagtacaataccagaccggcagggaagaagaagaacatgacggagaaaaccaaaggcatgattttcatcattttcgcctgcatcgggtcggtcggcggcgggttcagataggtttgggcgaacatcgttgccgccataatgatgggcaggatgtagtaggggtcggcgcggctgaggtcggtaatccaacccagccaaggtgcctggcgcaattctacggaggcgaacaatgcccaatacaatccgatgaagacggggatttgcaacagcataggcaggcagccgcccagcgggttgattttctcgtctgtgtaaagctgcatcatggcttgttgctgcgccatacggtcgtcgccgtatttctctttgatggcttgcagtttgggcgcggcggcacgcattttcgccatcgaacggtaagaggcgttggtcaatggatacagtacggctttgacgatgatggttaaaacgataatcgcccagccccagttgccgatgatgttgtgcagttggttcaaaagccaaaagaggggggaggcgaaccagtgtactttgccgtagtctttggccagttgcaggttgtcggcgatgtttgcgataacggatgtggtctgtgggccggcgtagaggttgatggaggcttcggtttcgcaccgttttggatagcggctaaaggcacgctgacgctggtgctgtacagcttgtcgttgcggcgtttgatgtcgatacggcagtcgccagcggcgcaaacgctttgtccgcctttgggttggaggatccaggtggacatgaagtggtgttcaatcatgccgagccagccggtcggggttttgcggatgtattcggcctcggatttgccggatttggcatcgtcgtccaagtcggagaagctgactttttggaagttgccttcaggggtataa

SEQ ID NO: 39559 - protein, 340 aa, Neisseria meningitidis
MLRHLGNDFALGALFFDAAVDVPLLGDGQEVVDHPVQYQTGREEEEHDGENQRHDFHHFRLHRVGRRRVQIGLGEHRCRHNDGQDVVGVGAAEVGNPTQPRCLAQFYGGEQCPIQSDEDGDLQQHRQAAAQRVDFLVCVKLHHGLLLRHTVVAVFLFDGLQFGRGGTHFRHRTVRGVGQWIQYGFDDDGNDNRPAPVADDVVQLVQKPKEGGGEPVYFAVVFGQLQVVGDVCDNGCGLWAGVEVDGGFGFAPFWIAAKGTLTLVLYSLSLRRLMSIRQSPAAQTLCPPLGWRIQVDMKWCSIMPSQPVGVLRMYSASDLPDLASSSKSEKLTFWKLPSGV

SEQ ID NO: 39560 - DNA, 525 bp, Neisseria gonorrhoeae
atgttgcggattgctgctgccaatcagttgggcggtcgaaatggtgcggcggtgggaaacggggtcgataagtttgggcgtggtgctgataatcaggttgagtttttggaaggaaacctgattgtagtcggcgcgtccgggcgtgccgctgtaacggtagccgtggcgcaattcgagcgtgcgtttgttgtccttcagcgagaagttaccttctttggcgaagatgatgttgtcgccgccgtttttgtcctgttcgcgcaggaacaggtttttcatgatgccggattcggtgtcaaaggtttcgacgaaataaaccctgccgttgcgcttgcccaagttattgaactcgccggcttccaccaaagacaattcctgcttctgcttcaaaatttcggcatattcgcggctgcgcagctctgcccacggtatcacccaaagctgcatgacggcaatcaggatggcaaacggcacggcaaactgcatgacggggcgtatccactgtttcaacgccaatccgcaggatag

SEQ ID NO: 39561 - protein, 174 aa, Neisseria gonorrhoeae
MLRIAAANQLGGRNGAAVGNGVDKFGRGADNQVEFLEGNLIVVGASGRAAVTVAVAQFERAFVVLQREVTFFGEDDVVAAVFVLFAQEQVFHDAGFGVKGFDEINPAVALAQVIELAGFHQRQFLLLLQNFGIFAAAQLCPRYHPKLHDGNQDGKRHGKLHDGAYPLFQRQSAG

SEQ ID NO: 39562 - DNA, 525 bp, Neisseria meningitidis
atgttgcgggttgctgctgccaatcagttgggcggtcggaatggtacggcggtgggaaacggggtcgatgagtttgggcgtggtgctgataatcaggttgagtttttggaaggaaacctgattgtagtcggcgcgtccgggcgtgccgctgtaacggtagccgtggcgcaattcgagcgtgcgtttgttgtcgttcagcgagaagttaccttctttggcgaagatgatgttgtcgccgccgtttttgtcctgttcgcgcaggaacaggtttttcatgatgccggattcggtatcgaaggtttcgacaaaataaaccctgccgttgcgcttgcccaaactgttgaactcgcctgcctccaccaaagacaattcctgcttctgcttcaggatttcagcgtattcgcggctgcgtagctctgcccacggtatcacccaaagctgcatgacggcaaccaaaacggcaaacggcacggcaaactgcatcaccgggcgtatccattgtttcaatgccaatccgcaggatag

SEQ ID NO: 39563 - protein, 174 aa, Neisseria meningitidis
  misc_feature (138)..(138): Xaa can be any naturally occurring amino acid
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVELACLHQRQFLLLLQDFSVFAAAXLCPRYHPKLHDGNQNGKRHGKLHHRAYPLFQCQSAG

SEQ ID NO: 39564 - DNA, 525 bp, Neisseria meningitidis
atgttgcgggttgctgctgccaatcagttgggcggtcggaatggtacggcggtgggaaacggggtcgatgagtttgggcgtggtgctgataatcaggttgagtttttggaaggaaacctgattgtagtcggcgcgtccgggcgtgccgctgtaacggtagccgtggcgcaattcgagcgtgcgtttgttgtcgttcagcgagaagttactttctttggcgaagatgatgttgtcgccgccgtttttgtcctgttcgcgcaggaacaggtttttcatgatgccggattcggtatcgaaggtttcgacaaaataaaccctgccgttgcgcttgcccaaactgttgaacccgcctgcctccaccaaagacaattcctgcttctgcttcaggatttcagcgtattcgcggctgcgtagctctgcccacggtatcacccaaagctgcatgacggcaaccaaaacggcaaacggcacggcaaactgcatcaccgggcgtatccattgtttcaatgccaatccgcaggatag

SEQ ID NO: 39565 - protein, 173 aa, Neisseria meningitidis
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVEPACLHQRQFLLLLQDFSVFAAALCPRYHPKLHDGNQNGKRHGKLHHRAYPLFQCQSAG

SEQ ID NO: 39566 - DNA, 1263 bp, Neisseria gonorrhoeae
atggacaatctcgtatgggacggcattcccgacatccgcacactcgaccaaaccatccgcaaacacgcacacccgctcaacctgattgtctgcctccccgataatcagattcccgattttcaaaccgcacaagatgcttcggactcggaatgccgtctgaagcaccgtttggatcaggcaacccagtgcctccagttcgacagcatcaacctcatcgaacacatcctgcccgatgtccgcttctggctggttcccccttcacgcacccgccgcctgcacgaacacttccaccacatttcctggcagaccgaagccatcccgcaaaccgaaagcaagtccgacaaaccctggtttgcacttccacaaacatccgaacggaaaaaaccggaacacgtcctcgtcatcggtgcaggcattgccggcgcatcgaccgcccacgccttagcatcacacggcatttccgttaccgtattggaagcccgaaaagccgctcaagccgccagcggcaaccggcaagggctgctttacgccaaaatctcgccgcacgacaccggacagaccgaactgctgcttgccggctacggctacaccaaacgcctgctcggacacatcctgcccgactccgacacttggggcggcaacggcatcatccacctcaattacagccgcaccgaacaacaacgcaatcacgaattgggtttgcaaaaacaccataaccacctctaccgcagcatcacgtctgcagaagccgaaaaaatcgccggcatcccgctgaacacgccctacgccgaaccattatgcggactctactggcaacacggcgtatggctcaatccgcccgcattcgtccgcaccctcctcagccatccgctgatcgaactatatgaaaacacaacgttaaccggcatttcccacgacggagaaaagtggattgcaagcacgccaaacggcacatttaccgccacacacatcatctactgcaccggcgcgcacagcccctgcctgcccgaaaccaacctcgccgccctacccctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagcaataccggatggaacgaagccgaagaagcctcaaaccgccaagcattggcacaccttaaccccgcccttgccgaatcattgttt

SEQ ID NO: 39567 - protein, 421 aa, Neisseria gonorrhoeae
MDNLVWDGIPDIRTLDQTIRKHAHPLNLIVCLPDNQIPDFQTAQDASDSECRLKHRLDQATQCLQFDSINLIEHILPDVRFWLVPPSRTRRLHEHFHHISWQTEAIPQTESKSDKPWFALPQTSERKKPEHVLVIGAGIAGASTAHALASHGISVTVLEARKAAQAASGNRQGLLYAKISPHDTGQTELLLAGYGYTKRLLGHILPDSDTWGGNGIIHLNYSRTEQQRNHELGLQKHHNHLYRSITSAEAEKIAGIPLNTPYAEPLCGLYWQHGVWLNPPAFVRTLLSHPLIELYENTTLTGISHDGEKWIASTPNGTFTATHIIYCTGAHSPCLPETNLAALPLRQIRGQTGLTPSTPFSEQLRCAVSGESYISPSWHGLHCYGASFIPNSSNTGWNEAEEASNRQALAHLNPALAESLF

SEQ ID NO: 39568 - DNA, 1620 bp, Neisseria meningitidis
atggacaatctcgtatgggacggcattcccgacatccgcacactcgaccaagccatccgcaaacacgcacccccgctcaacctgattatctgcctccccgataatcagattcccgattttcaaaccgcacaagatgcttcggacgcggaatgccgtctgaagcaccgtttggatcaggcaatgcagtgcctccagttcgacagcatcaacctcatcgaacacatcctgcccgatgtccgcttctggctggttcccccttcacgcacccaccacctgcacgaacatttccaccacatttcctggcagaccgaagccatcccgcaaaccgaaagcaagcccgacaaaccctggtttgcacttccacaaacatccgaacggcaaaaaccggaacacatcctcgttatcggcgcgggcatatccggcgcggcaaccgcccacgccttagcatcacacggcatttccgttaccgtattggaagcccgaaaagccgcccaagccgccagcggcaaccgccaagggctgctctacgccaaaatctcgccgcacgacaccgaacagaccgaacttttgcttgccggctacggctacaccaaacgcctgctcggacacatcctgcccgaatccgaaacctggggcggcaacggcatcatccacctcaattacagccgcaccgaacaacaacgcaatcacgaattgggtttgcaaaaacaccataaccacctctaccgcagcatcacatctgcagaagccgaaaaaatcgccggtatcccactgtccgtcccatacgaccacccttcatgcggactctactggcaacacggcgtatggctcaatccacccgcattcgtccgcaccctcctcaaccatccgctcattggactacacgaagacacacccttgaccgacatttcccacgacggggaaaagtggattgcaagcacgccaaacggcacatttaccgccacacacatcatctactgcaccggtgcgaacagcccctacctacccgaaaccaacctcgccgccctgcctctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagccataccggatggaacgaagccgaagaagcctcaaaccgccaagcattggcacaccttaaccccgccctttccgaatcattgtttgccgccaacccaaacccccaaaaacaccaagggcacgccgccatacgctgcgacagccccgaccaccttcccctagtcggcgcactcggcgacattgccgccatgcggcagacctacaccaaactcgcgctggacaaaaactaccgcatcgacaccccatgcccatacctgcctaatgcctacgtcaacaccgcgcacggcacccgcggactcgccaccgcccccatctgcgccgccgmcawtgcagcccaaatcstaggcytgccccatcccttttyacaacgcctgcgccacgccctacaccccaaccgcaccatcatccgcgccatcgtcagaaggaaggatctaaccccttaa

SEQ ID NO: 39569 - protein, 539 aa, Neisseria meningitidis
  misc_feature (501)..(502): Xaa can be any naturally occurring amino acid
  misc_feature (507)..(507): Xaa can be any naturally occurring amino acid
  misc_feature (514)..(514): Xaa can be any naturally occurring amino acid
MDNLVWDGIPDIRTLDQAIRKHAPPLNLIICLPDNQIPDFQTAQDASDAECRLKHRLDQAMQCLQFDSINLIEHILPDVRFWLVPPSRTHHLHEHFHHISWQTEAIPQTESKPDKPWFALPQTSERQKPEHILVIGAGISGAATAHALASHGISVTVLEARKAAQAASGNRQGLLYAKISPHDTEQTELLLAGYGYTKRLLGHILPESETWGGNGIIHLNYSRTEQQRNHELGLQKHHNHLYRSITSAEAEKIAGIPLSVPYDHPSCGLYWQHGVWLNPPAFVRTLLNHPLIGLHEDTPLTDISHDGEKWIASTPNGTFTATHIIYCTGANSPYLPETNLAALPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMRQTYTKLALDKNYRIDTPCPYLPNAYVNTAHGTRGLATAPICAAXXAAQIXGLPHPFXQRLRHALHPNRTIIRAIVRRKDLTP

SEQ ID NO: 39570 - DNA, 1620 bp, Neisseria meningitidis
atggacaatctcgcatggaacggcattcccgacatccgcacactcgaccaaaccatccgcaaacacgcacacccgctcaacctgattgtctgcctccccgataatcagattcccaattttcaaaccgcacaagatgcttcggacgcggaatgccgtctgaagcaccgtttggatcaggcaacccagtgcctccagttcgacagcatcaacctgattgaacacatcctgcccgatgtccgcttctggctggttcccccttcacgcacccgccgcctgcacgaacacttccaccacatttcctggcagaccgaagccatcccgcaaaccgaaagtaagcccgacaaaccctggtttgcacttccacaaacatccgaacggcaaaaaccggaacacatcctcgttatcggagcgggcatatccggcgcggcaaccgcccacgccttagcatcatacggcatttccgttaccgtattggaagcccgaaaagccgcccaagccgccagcggcaaccgccaagggctgctctacgccaaaatctcgccgcacgacaccgaacaaaccgaactgctgcttgccggctacggctacaccaaacgcctgctcggacatatcctgcccgaatccgaaacctggggcggcaacggcatcatccacctcaattacagccgcaccgaacaacaacgcaatcacgaattgggtttgcaaaaacaccataaccacctctaccgcagcatcacgcaggcagaagccgaaaaaatcgccggcatccctctgaacacgccctacgccgaaccattatgcggactgttttggcagtacggcgtatggctcaatcctcccacattcgtccgcgccctcctcagccatccgctcattggactacacgaagacacaccgttaaccgacatttcccacgacggggaaaagtggattgcaagcacgccaaacggcacatttaccgccacacacatcatctactgcaccggtgcgaacagcccctacctacccgaaaccaacctcgccaccctgcccctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagccataccggatggaacgaagccgaagaagcctcaaaccgccaagcattggcacaccttaaccccgccctttccgaatcattgtttgccgccaacccaaacccccaaaaacaccaagggcacgccgccatacgctgcgacagccccgaccaccttcccctagtcggcgcactcggcgacattgccgctatgcaacaaacttacgccaaactcgcgctggacaaaaactatcgcatcgatgccccctgcccgtacctgcccaatgcctacgccaacaccgcccacggcacacgcgggcttgccaccgcccccatctgcgccgccgccgttgcagccgaaatcctaggcttgccccatcccctctcaaaacgcctgcgccacgccctacaccccaaccgcgccatcatccgcgccatcgtcagaaggaaggatctaaccccttaa

SEQ ID NO: 39571 - protein, 539 aa, Neisseria meningitidis
MDNLAWNGIPDIRTLDQTIRKHAHPLNLIVCLPDNQIPNFQTAQDASDAECRLKHRLDQATQCLQFDSINLIEHILPDVRFWLVPPSRTRRLHEHFHHISWQTEAIPQTESKPDKPWFALPQTSERQKPEHILVIGAGISGAATAHALASYGISVTVLEARKAAQAASGNRQGLLYAKISPHDTEQTELLLAGYGYTKRLLGHILPESETWGGNGIIHLNYSRTEQQRNHELGLQKHHNHLYRSITQAEAEKIAGIPLNTPYAEPLCGLFWQYGVWLNPPTFVRALLSHPLIGLHEDTPLTDISHDGEKWIASTPNGTFTATHIIYCTGANSPYLPETNLATLPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMQQTYAKLALDKNYRIDAPCPYLPNAYANTAHGTRGLATAPICAAAVAAEILGLPHPLSKRLRHALHPNRAIIRAIVRRKDLTP

SEQ ID NO: 39572 - DNA, 606 bp, Neisseria gonorrhoeae
atgatacaaaagatatgtaagctatttgttttaattgtaatttttgcaacttctcccgcttttgcccttcaaagcgacagcagacggcccatccaaatcgaagccgaccaaggttcgctcgatcaagccaaccaaaggaccacatttagcggcaatgtcatcatcagacagggtacgctcaacatttccgcctcgtgtgtcaacgtcacacgcggcaggcaaaggcggcgaatccgtgagggcggaaggttcgcccgtccgcttcagccaaacgttggacgggggcaaagggacggtgcgcggtcaggcaaacaacgttacctattcctccgcaggaagcactgtcgttctgaccggcaatgccaaagtgcagcgcggcggcgacgttgccgaaggtgcggtcattacctacaacaccaaaaccgaagtctataccatcaacggcagcacgaaatcgggtgcgaaatccgcttccaaaaccggcagggtcagcgtcgtcatccagccttcaagcacacaaaaaaccgaataaccccgatgccgtctgaaacggaaacgcagttcagacggcatttgccgaccgaaatgccgagaagagattattga

SEQ ID NO: 39573 - protein, 201 aa, Neisseria gonorrhoeae
MIQKICKLFVLIVIFATSPAFALQSDSRRPIQIEADQGSLDQANQRTTFSGNVIIRQGTLNISASCVNVTRGRQRRRIREGGRFARPLQPNVGRGQRDGARSGKQRYLFLRRKHCRSDRQCQSAARRRRCRRCGHYLQHQNRSLYHQRQHEIGCEIRFQNRQGQRRHPAFKHTKNRITPMPSETETQFRRHLPTEMPRRDY

SEQ ID NO: 39574 - DNA, 455 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatt

SEQ ID NO: 39575 - protein, 151 aa, Neisseria meningitidis
MIQKICKLFVLIAFFSASPAFALQSDSRQPIQIEADQGSLDQANQSTTFSGNVVIRQGTLNISAARVNVTRGRQRRRIREGGRFASPLQPDIGRRQRHGARTGKQRCLFICRQHRSLNRCQSTARRRCRRRCGDYIQHQNRSLYHQRQHKI

SEQ ID NO: 39576 - DNA, 605 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaatgccgtctgaaacataaacctggttcggacggcatttgccgaccgaaatattgaagagatatttatga

SEQ ID NO: 39577 - protein, 199 aa, Neisseria meningitidis
  misc_feature (73)..(73): Xaa can be any naturally occurring amino acid
MIQKICKLFVLIAFFSASPAFALQSDSRQPIQIEADQGSLDQANQSTTFSGNVVIRQGTLNISAARVNVTRGXQRRRIREGGRFASPLQPDIGRRQRHGARTGKQRCLFICRQHRSLNRCQSTARRRCRRRCGDYIQHQNRSLYHQRQHKIRRKIRFQIRQGQRRYPAFEYAKIRIIPMPSETTWFGRHLPTEILKRYL

SEQ ID NO: 39578 - DNA, 531 bp, Neisseria gonorrhoeae
atgatacaaaagatatgtaagctatttgttttaattgtaatttttgcaacttctcccgcttttgcccttcaaagcgacagcagacggcccatccaaatcgaagccgaccaaggttcgctcgatcaagccaaccaaagtaccacatttagcggcaatgtcatcatcagacagggtacgctcaacatttccgcctcgcgcgtcaacgtcacacgcggcggcaaaggcggcgaatccgtgagggcggaaggttcgcccgtccgcttcagccaaacgttggacgggggcaaagggacggtgcgcggtcaggcaaacaacgttacctattcctccgcaggaagcaccgtcgttctgaccggcaatgccaaagtgcagcgcggcggcgacgttgccgaaggtgcggtcattacctacaacaccaaaaccgaagtctataccatcaacggcagcacgaaatcgggtgcgaaatccgcttccaaaaccggcagggtcagcgtcgtcatccagccttcaagcacacaaaaaaccgaataa

SEQ ID NO: 39579 - protein, 176 aa, Neisseria gonorrhoeae
MIQKICKLFVLIVIFATSPAFALQSDSRRPIQIEADQGSLDQANQSTTFSGNVIIRQGTLNISASRVNVTRGGKGGESVRAEGSPVRFSQTLDGGKGTVRGQANNVTYSSAGSTVVLTGNAKVQRGGDVAEGAVITYNTKTEVYTINGSTKSGAKSASKTGRVSVVIQPSSTQKTE

SEQ ID NO: 39580 - DNA, 531 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataa

SEQ ID NO: 39581 - protein, 176 aa, Neisseria meningitidis
MIQKICKLFVLIAFFSASPAFALQSDSRQPIQIEADQGSLDQANQSTTFSGNVVIRQGTLNISAARVNVTRGGKGGESVRAEGSPVRFSQTLDGGKGTVRGQANNVAYSSAGSTVVLTGNAKVQRGGDVAEGAVITYNTKTEVYTISGSTKSGAKSASKSGRVSVVIQPSSTQKSE

SEQ ID NO: 39582 - DNA, 531 bp, Neisseria meningitidis; identical to SEQ ID NO: 39580

SEQ ID NO: 39583 - protein, 176 aa, Neisseria meningitidis; identical to SEQ ID NO: 39581

SEQ ID NO: 39584 - DNA, 582 bp, Neisseria gonorrhoeae
atgaaagtaagatggcggtacggaattgcgttcccattgatattggcggttgccttgggcagcctgtcggcatggttgggccgtatcagcgaagtcgaaatcgaggaagtcaggctcaatcccgacgaacctcaatacacaatggacggcttggacggaaggcggtttgacgaacagggatacttgaaagaacatttgagcgcgaaaggtgcgaaacagtttcccgaaaacagcgacatccattttgattcgccgcatctcgtgttcttccaagaaggcaggctgttgtacgaagtcggcagcgatgaagccgtttaccataccgaaaacaaacaggttctttttaaaaacaacgttgtgctgaccaaaaccgccgacggcaggcggcaggcgggtaaagtcgaaaccgaaaaactgcacgtcgataccgaatctcaatatgcccaaaccgatacgcctgtcagtttccaatatggcgcgtcgcacggtcaggcgggcggtatgacctacaaccacaaaacaggcatgttgaacttctcatctaaagtgaaagccgcgatttatgatacaaaagatatgtaa

SEQ ID NO: 39585 - protein, 193 aa, Neisseria gonorrhoeae
MKVRWRYGIAFPLILAVALGSLSAWLGRISEVEIEEVRLNPDEPQYTMDGLDGRRFDEQGYLKEHLSAKGAKQFPENSDIHFDSPHLVFFQEGRLLYEVGSDEAVYHTENKQVLFKNNVVLTKTADGRRQAGKVETEKLHVDTESQYAQTDTPVSFQYGASHGQAGGMTYNHKTGMLNFSSKVKAAIYDTKDM

SEQ ID NO: 39586 - DNA, 521 bp, Neisseria meningitidis
agcctgtcggcatggttgggtcgtatcagcgaagtcgagattgaagaagtcaggctcaatcccgacgaaccgcaatacacaatggacagcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgcagtttccaatatggtgcatcgcacggtcaggcgggcggcatgacttacgaccacawwacaggcatgttgaacttctcatctaaagtgaaagccacgatttatgatacaaaagatatgtaa

SEQ ID NO: 39587 - protein, 173 aa, Neisseria meningitidis
  misc_feature (153)..(153): Xaa can be any naturally occurring amino acid
SLSAWLGRISEVEIEEVRLNPDEPQYTMDSLDGRRFDEQGYLKEHLSAKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHXTGMLNFSSKVKATIYDTKDM

SEQ ID NO: 39588 - DNA, 582 bp, Neisseria meningitidis
atgaaagtaagatggcggtacggaattgcgttcccattgatattggcggttgccttgggcagcctgtcggcatggttgggacgcatcagcgaagtcgagattgaagaagtcaggctcaatcccgacgaaccgcaatacacaatggacggattggatggcaggcggtttgacgaacagggatacttgaaagaacatttgagttcgaagggcgcgaaacagtttcccgaaagcagcgacattcatttcgactcaccgcatctcgtgttcttccaagaaggcaggttgttgtacgaagtcggcagcgatgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaa

SEQ ID NO: 39589 - protein, 193 aa, Neisseria meningitidis
MKVRWRYGIAFPLILAVALGSLSAWLGRISEVEIEEVRLNPDEPQYTMDGLDGRRFDEQGYLKEHLSSKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHKTGMLNFSSKVKATIYDTKDM

SEQ ID NO: 39590 - DNA, 468 bp, Neisseria gonorrhoeae
atgatatcgatttcgagctcggtacccagcgacgaaatcaccgccatcatccccgcactcaaacgcaaagacattaccctcgtctgcatcaccgcccgccccgattcaaccatggcgcgccatgccgatatccacatcaccgcatcggtttcgcaagaagcctgcccgttggggcttgccccgaccaccagcaccaccgccgttatggctttgggcgacgcgttggcggtcgtcctgctgcgcgcccgcgcgttcacgcccgacgacttcgccttgatccaccctgccggcagcctcggcaaacgcctgcttttgcgcgttgccgacattatgcacaaaggcggcggcctgcccgccgtccgactcggcacgcccttgaaaggagccatcgtcagcatgagcgagaaaggtttgggcatgtgggcgggaacggacgggcaaaggctgtctgaaaggcctttttactga

SEQ ID NO: 39591 - protein, 155 aa, Neisseria gonorrhoeae
MISISSSVPSDEITAIIPALKRKDITLVCITARPDSTMARHADIHITASVSQEACPLGLAPTTSTTAVMALGDALAVVLLRARAFTPDDFALIHPAGSLGKRLLLRVADIMHKGGGLPAVRLGTPLKGAIVSMSEKGLGMWAGTDGQRLSERPFY

SEQ ID NO: 39592 - DNA, 981 bp, Neisseria meningitidis
atggcaatggcagaaaacggaaaatatctcgactgggcacgcgaagtgttgcacgccgaagcggaaggcttgcgcgaaattgcagcggaattgsacaaaaacttcgtccttgcggcagacgcgttgttgcactgcaagggcagggtcgttatcacgggcatggtcaagtcgggacatatcgggcgcaaaatggcggcaactatggcctcgaccggcacgcctgcgtttttcgtccaccctgcggaagcggcacacggcgatttgggtatgattgtggacarcgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatag

SEQ ID NO: 39593 - protein, 326 aa, Neisseria meningitidis
  misc_feature (32)..(32): Xaa can be any naturally occurring amino acid
  misc_feature (94)..(94): Xaa can be any naturally occurring amino acid
MAMAENGKYLDWAREVLHAEAEGLREIAAELXKNFVLAADALLHCKGRVVITGMVKSGHIGRKMAATMASTGTPAFFVHPAEAAHGDLGMIVDXDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 39594 - DNA, 981 bp, Neisseria meningitidis
atggcgatggcaggaaacgaaaaatatcttgattgggcacgcgaagtgttgcacaccgaagcggaaggcttgcgcgaaattgcggcggatttggacgaaaacttcgcccttgcggcggacgcgttgttgcactgcaaaggcagggtcgttatcacgggcatgggcaagtcgggacatatcgggcgcaaaatggcggcaaccatggcctcgaccggcacgcccgcgtttttcgtccaccctgcggaagcggcacacggcgatttgggcatgattgtggacaacgacgtggtcgtcgcgatttccaattccggtgaaagcgacgaaatcgccgccatcatccccgcgctcaaacgcaaagatatcacgcttgtctgcatcaccgcccgccccgattcaaccatggcgcgccatgccgacatccacatcacggcgtcggtttccaaagaagcctgcccgctggggcttgccccgaccaccagcaccaccgccgttatggctttgggcgatgcgttggcggttgtcctgctgcgcgcccgcgcgttcacgcccgacgacttcgccttgagccaccctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgaccttttggcggcgcggattgtatag

SEQ ID NO: 39595 - protein, 326 aa, Neisseria meningitidis
MAMAGNEKYLDWAREVLHTEAEGLREIAADLDENFALAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 39596 - DNA, 681 bp, Neisseria gonorrhoeae
atggcggatgacggtttgttgcggcaactgtccgaaaaacccagccaaagtgctctcttcctgccatttgacccattcgttttcgaggttttggactgccttttggtcatcgggcccggcttgaaacaatgtttcaagcaaatcccggcaacgcgccacccattcgccgaccgtcgcaggttgccgccatatccgggcaatatccgacagggtttcgaggaaggcggcaaaacgtccgaacatggcggtttgattcacgtcggcataccacgcgctgacatcctgccacatcgggttgccgccttcgggcagcatccagcccaatatcatacggtctgccgcctgcttccaggtaaacagctgatccgtgccgccgcgcatttctccgtccaatccccaatggacgttcaaatcggcaaccatatcgtgcaaaagcggcaaatcgtccccggtcagtccgaaacggcgcaacacgggcgcggtttccaaaagcgcgagcactttgccgacttcaaaacggctttccagcaagtcggacacgcactccaacgcataaaaaaacggttgccggcggctgattttcacgtccgaaacggaatacggcaatgcctgcgcgccgggttgcgcctgtccgaacacggcttccataaaaggcgtatagggttcgatattcggggttaa

SEQ ID NO: 39597 - protein, 226 aa, Neisseria gonorrhoeae
MADDGLLRQLSEKPSQSALFLPFDPFVFEVLDCLLVIGPGLKQCFKQIPATRHPFADRRRLPPYPGNIRQGFEEGGKTSEHGGLIHVGIPRADILPHRVAAFGQHPAQYHTVCRLLPGKQLIRAAAHFSVQSPMDVQIGNHIVQKRQIVPGQSETAQHGRGFQKREHFADFKTAFQQVGHALQRIKKRLPAADFHVRNGIRQCLRAGLRLSEHGFHKRRIGFDIRG

SEQ ID NO: 39598 - DNA, 681 bp, Neisseria meningitidis
atggcggatgacggtgtgcggcggcaactgtccggaaaattgcgccaattcggtttccgcctrccatttgacccattcgttttcaaggttttggactgacttttggtcatcggcttcagcttggaacaatgtttcaagcaaatcccggcaacgcgccacccattcgccgaccgttgcgggctgccgccatatccgtacaatatccgtcagggtttcgaggaaggcggcaaaacgtccgaacatggcggtttgattcacgtcggcataccacgcgctgacatcctgccacatcggattgccgcctttgggcagcatccagcccaatatcatgcgttctaccgcctgcttccaggtgaacagctgatccgtgccgccgcgcatttctccgtccaaaccccagtggacgttcaaatcggcaaccatgtcgtgcaaaagcggtaaatcgtcctcagtcagtccgaaacggcgcaacacgggcgcggtttctaaaagcacaagcactttatcgacttcaaatcggctttccaacaagtcgaacaggcatgacaaagcatgaaacagcggttggcggcggctgattttcacgtctgacacggaatacggcaatgcctgcgcaccgggctgcgcctgtccgaacacggcttcgataaaaggcgtataggattcgatattcggggttaa

SEQ ID NO: 39599 - protein, 226 aa, Neisseria meningitidis
  misc_feature (33)..(33): Xaa can be any naturally occurring amino acid
  misc_feature (147)..(147): Xaa can be any naturally occurring amino acid
  misc_feature (163)..(163): Xaa can be any naturally occurring amino acid
  misc_feature (182)..(182): Xaa can be any naturally occurring amino acid
  misc_feature (197)..(197): Xaa can be any naturally occurring amino acid
MADDGVRRQLSGKLRQFGFRLPFDPFVFKVLDXLLVIGFSLEQCFKQIPATRHPFADRCGLPPYPYNIRQGFEEGGKTSEHGGLIHVGIPRADILPHRIAAFGQHPAQYHAFYRLLPGEQLIRAAAHFSVQTPVDVQIGNHVVQKRXIVLSQSETAQHGRGFXKHKHFIDFKSAFQQVEQAXQSMKQRLAAADFHVXHGIRQCLRTGLRLSEHGFDKRRIGFDIRG

SEQ ID NO: 39600 - DNA, 681 bp, Neisseria meningitidis
gtggcggatgacggtgtgcagcggcaactgtccggaaaattgcgccaattcggtttccgcctgccatttgacccattcgttttcgaggctttggactgccttttggtcatcgccttcgacttggaacaatgtttcaagcaaatcccggcaacgcgccacccattcgtcaaccgtcgcaggttgccgccatatccgtacaatatccgtcagggtttcgaggaaggcggcaaaacgtccgaacagggcggtttggttcacgtcggcataccacgcgctgaccccctgccacatcggattgccgccttcgggcagcatccagcccaatatcatgcgttctaccgcctgcttccaggtgaacagctgatccgtgccgccgcgcatttctccgtccaaaccccagcggacgttcaaatcggcaaccatgtcgtgcaaaagcggcaaatcgtcctcagtcagtccgaaatggcgcaacacgggcgcggtttctaaaagcacaagcactttatcgacttcaaatcggctttccaacaagtcgaacaggcatgacaaagcatgaaacagcggttgtcggcggctgattttcacatccgaaacggaatacggcaatgcctgcgcgccgggctgcgcctgtccgaacacggcttcgataaaaggcgtataggattcgatattcggggttaa

SEQ ID NO: 39601 - protein, 224 aa, Neisseria meningitidis
VADDGVQRQLSGKLRQFGFRLPFDPFVFEALDCLLVIAFDLEQCFKQIPATRHPFVNRRRLPPYPYNIRQGFEEGGKTSEQGGLVHVGIPRADPLPHRIAAFGQHPAQYHAFYRLLPGEQLIRAAAHFSVQTPADVQIGNHVVQKRQIVLSQSEMAQHGRGFKHKHFIDFKSAFQQVEQAQSMKQRLSAADFHIRNGIRQCLRAGLRLSEHGFDKRRIGFDIRG

SEQ ID NO: 39602 - DNA, 657 bp, Neisseria gonorrhoeae
atggttgcggtggatccttatacggcaaaagtggtcaacaccatgccgcgcaatcagggttggtatcacactatggatgaaatccacggcgatatgatgctcggtgcggcaggcgattatcttttggaaacggcagcttcactgaccattattatggttgtcagcggcttgtacctttggtgggcgaaacagcgcggcattaaagcgatgctgctgccgccaaaaagcagggcgcgttcttggtggcggaatctgcacggcgcgtttggaacttgggtgtcgttgattttactgttgttctgcctgtcgggtattgcttgggcaggtatttggggcggcaaattcgtgcaggcttggaatcagttcccggccggcaaatggggtgtcgaaccgaaccccgtttcaatcgtgccgacccacggcgaggtattgaatgacggcaaggttaaggaagtgccgtggattttggagcttatgcctatgcctgtctcagggacgactgtgggtgaaaacggcattaaccccaccgagcccaataacattggaaaccgtcgaccgtttcgcgcgggaaatcggtttcaaagggcgttatcagttgaatttgcccaaaggcgaggacggggtatggactttgtcgcaggattctatgagttatga

SEQ ID NO: 39603 - protein, 218 aa, Neisseria gonorrhoeae
MVAVDPYTAKVVNTMPRNQGWYHTMDEIHGDMMLGAAGDYLLETAASLTIIMVVSGLYLWWAKQRGIKAMLLPPKSRARSWWRNLHGAFGTWVSLILLLFCLSGIAWAGIWGGKFVQAWNQFPAGKWGVEPNPVSIVPTHGEVLNDGKVKEVPWILELMPMPVSGTTVGENGINPTEPNNIGNRRPFRAGNRFQRALSVEFAQRRGRGMDFVAGFYEL

SEQ ID NO: 39604 - DNA, 654 bp, Neisseria meningitidis
  misc_feature (568)..(568): n is a, c, g, or t
atggtcgcggtcgatccttatacggcaaaagtggtcagtaccatgccgcgcaatcagggttggtattacacgatggatgaaatccacagcgatatgatgctcggtgcggcaggcgattatcttttggaaacggcagcttcactgaccattattatggttgtcagcggcttgtacctttggtgggtgaaacggcgcggcatcaaggcgatgctgctgccgtcaaaaggcarggcgcgttcttggtggcggaatctgcacggcacgtttggaacttgggtgtcgttgattttgctgttgttctgcctgtcgggtattgcttgggcgggtatttggggcggcaagttcgtacaggcttggagtcagttccctgccggtaaatggggtgtcgaaccgaaccccgtttcagtcgtgccgacccacggcgaggtattgaatgacggcaaggttaaggaagtgccgtgggttttggagcttacgcctatgcctgtttcagggacgacygtgggcaaagacggcattaaccctgacgagccgatgacattggaaaccgtcgaccgctttgcgcggngaaatcggtttcaaagggcgttatcagttgaatttgcccaaaggcgaggacggcgtatggactttgtcgcaggattctatgagtta

SEQ ID NO: 39605 - protein, 218 aa, Neisseria meningitidis
  misc_feature (77)..(77): Xaa can be any naturally occurring amino acid
  misc_feature (190)..(190): Xaa can be any naturally occurring amino acid
MVAVDPYTAKVVSTMPRNQGWYYTMDEIHSDMMLGAAGDYLLETAASLTIIMVVSGLYLWWVKRRGIKAMLLPSKGXARSWWRNLHGTFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSVEFAQRRGRRMDFVAGFYEL

SEQ ID NO: 39606 - DNA, 653 bp, Neisseria meningitidis
atggtcgcggtcgatccttatacggcaaaagtggtcagtaccatgccgcgcaatcagggttggtattacgcgatggatgaaatccacagcgatatgatgctcggttcgacaggtgattatcttttggaaacggctgcatcgctgacgattatcatgataatcagcggtttgtacctttggtgggtgaaacggcgcggcatcaaggcgatgctgctgccgccaaaaggcagggcgcgttcttggtggcggaatctgcacggcgcgtttggaacttgggtgtcgttgattttactgttgttctgcctgtcgggtattgcttgggcaggtatttggggcggcaagttcgtgcaggcttggagtcagttcccggcaggcaaatggggtgtcgaaccgaaccctgtttcagtcgtgccgacccacggcgaggtattgaatgacggcaaggttaaggaagtgccgtgggttttggagcttacgcctatgcctgtttcagggacgactgtgggcaaagacggtattaaccctgacgagccgatgacattggaaaccgtcgaccgttttgcgcgggaaatcggtttcaaagggcgttatcagctgaatttgcccaaaggcgaggacggcgtatggactttgtcgcaggattctatgagtta

SEQ ID NO: 39607 - protein, 218 aa, Neisseria meningitidis
  misc_feature (190)..(190): Xaa can be any naturally occurring amino acid
MVAVDPYTAKVVSTMPRNQGWYYAMDEIHSDMMLGSTGDYLLETAASLTIIMIISGLYLWWVKRRGIKAMLLPPKGRARSWWRNLHGAFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSAEFAQRRGRRMDFVAGFYEL

SEQ ID NO: 39608 - DNA, 642 bp, Neisseria gonorrhoeae
atgacggcaaggttaaggaagtgccgtggattttggagcttatgcctatgcctgtctcagggacgactgtgggtgaaaacggcattaaccccaccgagcccaataacattggaaaccgtcgaccgtttcgcgcgggaaatcggtttcaaagggcgttatcagttgaatttgcccaaaggcgaggacggggtatggactttgtcgcaggattctatgagttatgacatgatcagcccgtttgccgaccgcacggtacatatcgaccagtacagcggcgagattcttgccgacatccgttttgacgattacaacccgttcggcaaatttatggcggcaagcattgcgctgcatatggggactttgggctggtggagcgtgttggcgaacgtcgtgttctgccttgccgtgatttttatcggcatcagcggctgcgtgatgtggtggaaacgccgtccgtccggcgtggcgggcattgttcctccggcgcaaaaaatcaaactgcccgtctggtgggcgatggcattgccgctgctgttgattgcactgcttttcccgaccgcgctgcttgccattgccgtgatttggctgttggataccttgctgctgtcgcggattcctgtgttgaggaaatggtttaaatga

SEQ ID NO: 39609 - protein, 213 aa, Neisseria gonorrhoeae
MTARLRKCRGFWSLCLCLSQGRLWVKTALTPPSPITLETVDRFAREIGFKGRYQLNLPKGEDGVWTLSQDSMSYDMISPFADRTVHIDQYSGEILADIRFDDYNPFGKFMAASIALHMGTLGWWSVLANVVFCLAVIFIGISGCVMWWKRRPSGVAGIVPPAQKIKLPVWWAMALPLLLIALLFPTALLAIAVIWLLDTLLLSRIPVLRKWFK

SEQ ID NO: 39610 - DNA, 642 bp, Neisseria meningitidis
  misc_feature (135)..(135): n is a, c, g, or t
atgacggcaaggttaaggaagtgccgtgggttttggagcttacgcctatgcctgtttcagggacgacygtgggcaaagacggcattaaccctgacgagccgatgacattggaaaccgtcgaccgctttgcgcggngaaatcggtttcaaagggcgttatcagttgaatttgcccaaaggcgaggacggcgtatggactttgtcgcaggattctatgagttacgacatgatcagcccgtttgccgaccgcacggtacatatcgaccagtacagcggcaaaatccttgccgacatccgttttgacgattacaacccgttcggcaaatttatggcggcaagcattgcgctgcatatggggactctgggctggtggagcgtgttggcgaacgtcttgttctgccttgccgtcatttttatcggtatcagcggctgcgtgatgtggtggaaacgccgtccgaccggagcggtgggcatcgttccgccggcgcagaaagtcaagctgccggtttggtggatgatggcattgccgctattggcaatcgcactgctcttcccgacctcactgcttgccattgccgtgatttggctgttggatacgctgctgttgtcgcggattcctgttttgaggagatggtttaaatga

SEQ ID NO: 39611 - protein, 213 aa, Neisseria meningitidis
  misc_feature (23)..(23): Xaa can be any naturally occurring amino acid
  misc_feature (35)..(35): Xaa can be any naturally occurring amino acid
MTARLRKCRGFWSLRLCLFQGRXWAKTALTLTSRXHWKPSTALRGEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPTGAVGIVPPAQKVKLPVWWMMALPLLAIALLFPTSLLAIAVIWLLDTLLLSRIPVLRRWFK

SEQ ID NO: 39612 - DNA, 641 bp, Neisseria meningitidis
atgacggcaaggttaaggaagtgccgtgggttttggagcttacgcctatgcctgtttcagggacgactgtgggcaaagacggtattaaccctgacgagccgatgacattggaaaccgtcgaccgttttgcgcgggaaatcggtttcaaagggcgttatcagctgaatttgcccaaaggcgaggacggcgtatggactttgtcgcaggattctatgagttacgacatgatcagcccgtttgctgaccgcacggtgcatatcgaccagtacagcggcaagattcttgccgacatccgttttgacgattacaacccgttcggcaaatttatggcggcaagcattgcgctgcatatggggactttgggctggtggagcgtgttggcgaacgttttgttctgccttgccgtgatttttatcggcatcagcggctgcgtgatgtggtggaaacgccgtccgtccggcgcggtgggcatggttccgccggcgcaaaaaatcaagctgcccgtctggtgggcaatggcggtgccgctgctgctgattgcattgcttttcccgaccgcgttgcttgccattgccgtgatttggctgttggatacgctgctgttgtcgcggattcctgttttgaggagatggtttaaatga

SEQ ID NO: 39613 - protein, 212 aa, Neisseria meningitidis
  misc_feature (44)..(44): Xaa can be any naturally occurring amino acid
MTARLRKCRGFWSLRLCLFQGRLWAKTVLTLTSRHWKPSTVLRXEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPSGAVGMVPPAQKIKLPVWWAMAVPLLLIALLFPTALLAIAVIWLLDTLLLSRIPVLRRWFK

SEQ ID NO: 39614 - DNA, 558 bp, Neisseria gonorrhoeae
atgcacgaccacggcgccatggatcgccgcctccccgctttcggaagtctgatgcggcgagccgtaaatcadatcgacgctgacggatttgaaccctgcctcacgggcggcatcgatgacttctttggtttcttcgtagctttggatgcggttgactgccgcctgcactttggggtcgaaatcctgaatgccgacgctcatgcggttgaagccgagtctgccgagcatgaggacggtgtcgcggctgactttgcgcgggtcgatttcgatggaatattcgccggacggtatcagttcgaaatgtttgcggatcatgcggaagacacgttcgatctgttcgtcgctcaaaaaggtcggcgtgccgccgccgaagtgcagttgggcaagctggtgccgtccgttcagatgtggagcgagcagttccatttctttttcaagatattcgatgtaggtatcggcgcggcttttgtctttggtgatgattttgttgcagccgcagtagtagcagatggtgttgcaaaacggaatgtgaatgtaaagggaaagcggtttgtttaa

SEQ ID NO: 39615 - protein, 185 aa, Neisseria gonorrhoeae
  misc_feature (24)..(24): Xaa can be any naturally occurring amino acid
MHDHGAMDRRLPAFGSLMRRAVNXIDADGFEPCLTGGIDDFFGFFVALDAVDCRLHFGVEILNADAHAVEAESAEHEDGVAADFARVDFDGIFAGRYQFEMFADHAEDTFDLFVAQKGRRAAAEVQLGKLVPSVQMWSEQFHFFFKIFDVGIGAAFVFGDDFVAAAVVADGVAKRNVNVKGKRFV

SEQ ID NO: 39616 - DNA, 531 bp, Neisseria meningitidis
atggyggttttgatgcwcmgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatctgttcgtcgctcaaaaaggtgcgtgccccgccgaagtgcagttgggcaagctggtgccgtccgttcagatgtggagcgagcagttccatttctttttcaagatattcgatgtaggcatcggcgcggcttttgtctttggtgatgattttgttgcagccgcagtagtagcagatggtgttgcagaacggaatgtgaatgtaaagggaaagcggtttgtttaa

SEQ ID NO: 39617 - protein, 176 aa, Neisseria meningitidis
  misc_feature (2)..(2): Xaa can be any naturally occurring amino acid
  misc_feature (6)..(6): Xaa can be any naturally occurring amino acid
  misc_feature (90)..(90): Xaa can be any naturally occurring amino acid
MXVLMXRSLVRQAVNQIDADGFEPRFARRIDDFFGFFVTLDAVDRRLHFGVEILNADAHAVEAESAEHEDGVAADFARVDFDGVFAGGDXLEMFAYHAEDTFDLFVAQKGACPAEVQLGKLVPSVQMWSEQFHFFFKIFDVGIGAAFVFGDDFVAAAVVADGVAERNVNVKGKRFV

SEQ ID NO: 39618 - DNA, 534 bp, Neisseria meningitidis
atggtggttttgatgctccgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatttggtcgtcgctcaaaaaggtcggcgtgccgccgccgaagtgcagttgggcaagctggtgccgtccgttcagatgtggagcgagcagttccatttctttttcaagaaattcgatgtaggcatcggcgcggcttttgtctttggtgatgattttgttgcagccgcagtagtagcagatggtgttgcagaacggaatgtgaatgtaaagggaaagcggtttgtttaa

SEQ ID NO: 39619 - protein, 176 aa, Neisseria meningitidis
MVVLMLRSLVRQAVNQIDADGFEPRFARRIDDFFGFFVTLDAVDRRLHFGVEILNADAHAVEAESAEHEDGVAADFARVDFDGVFAGGDLEMFAYHAEDTFDLVVAQKGRRAAAEVQLGKLVPSVQMWSEQFHFFFKKFDVGIGAAFVFGDDFVAAAVVADGVAERNVNVKGKRFV

SEQ ID NO: 39620 - DNA, 360 bp, Neisseria gonorrhoeae
atggaattcaggcaccaggtagtggtagttggtgtcgaaccatttggtcatttcgatggcgaattggtctttgttgccgcgcgccagttggaagaattgttccaaaggcaggttttggctatcgaagccgaaacgggcgggaatcgcgcccgtggatacttgcaggtcgaggatgtgatggtagaaagtgaaatcacgtacagcaacgtaatcagcgttaggagcagcttggtgtttccagtttttctcgcgcaggtctttggcaacgtcgagcagctcttgttcactgatctctttgcgccagtatttttcttgggcgaatttcaattcacggaaggcgccgacacgcgggaagcctga

SEQ ID NO: 39621 - protein, 119 aa, Neisseria gonorrhoeae
MEFRHQVVVVGVEPFGHFDGELVFVAARQLEELFQRQVLAIEAETGGNRARGYLQVEDVMVESEITYSNVISVRSSLVFPVFLAQVFGNVEQLLFTDLFAPVFFLGEFQFTEGADTREA

SEQ ID NO: 39622 - DNA, 359 bp, Neisseria meningitidis
gtggaattcaggcaccaagtagtggtagttggtgtcgaaccatttggtcatttcgatagcgaattggtctttgttaccgcgcgccagttggaagaattgttccaaagacaggttttggctgtcgaagccgaagcgggcgggaatcgcgccggtggcgacttgcaggtcgaggatgtggtcgtagaaagtgaaatcsctacggcaacgaaatcggcgttggcagcgacctggtgtttccagtttttctcgcgcaagtctttagcaacagccagcaattcttgctcgctgatttctttgcgccagtatttttcttgtgcgaatttcaattcgcggaaggcgccgacacgcgggaagcctga

SEQ ID NO: 39623 - protein, 119 aa, Neisseria meningitidis
  misc_feature (66)..(66): Xaa can be any naturally occurring amino acid
VEFRHQVVVVGVEPFGHFDSELVFVTARQLEELFQRQVLAVEAEAGGNRAGGDLQVEDVVVESEIXYGNEIGVGSDLVFPVFLAQVFSNSQQFLLADFFAPVFFLCEFQFAEGADTREA

SEQ ID NO: 39624 - DNA, 360 bp, Neisseria meningitidis
gtggaattcaggcaccaagtagtggtagttggtgtcgaaccatttggtcatttcgatagcgaattggtctttgttaccgcgcgccagttggaagaattgttccaaagataggttttggctgtcgaagccgaagcgggcgggaatcgcgccggtggcgacttgcaggtcgaggatgtggtcgtagaaagtgaaatcgcctacggcaacgtaatcggcgttggcagcggcctggtgtttccagtttttctcgcgcaagtctttagcaacagccagcaattcttgctcgctgatttctttgcgccagtatttttcttgtgcgaatttcaattcgcggaaggcaccgacacgcgggaagcctga

SEQ ID NO: 39625 - protein, 118 aa, Neisseria meningitidis
VEFRHQVVVVGVEPFGHFDSELVFVTARQLEELFQRVLAVEAEAGGNRAGGDLQVEDVVVESEIAYGNVIGVGSGLVFPVFLAQVFSNSQQFLLADFFAPVFFLCEFQFAEGTDTREA

SEQ ID NO: 39626 - DNA, 669 bp, Neisseria gonorrhoeae
  misc_feature (250)..(250): n is a, c, g, or t
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccgtcaaccgagcccccgcccggcgggcgggcaatgccgacgaactcatcggcggcgcgatggggcttaacgaacagcccgttgtacgcgtcaaccgagccnccgcccggcgggcgggcaatgccgacaaactcatcggcagcgcgatgcggcttttgggtattgcctaccgctacggcggcacatcggtgtctaccggttttgactgcagcggattcatgcagcacatcttcaaacgcgccatgggcatcaacctgccgcgcacgtcggcggaacaggcgcggatgggcgcacccgttgcccgaagcgaattgcagcccggggatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatatgcgttcgcccgccgggtcaagaaaaacgacccgtcacgctttctgaactga

SEQ ID NO: 39627 - protein, 222 aa, Neisseria gonorrhoeae
  misc_feature (84)..(84): Xaa can be any naturally occurring amino acid
MDSFFKPAVWAVLWLMFAVRPALADELTNLLSSREQILRQFAEDEQPVLPVNRAPARRAGNADELIGGAMGLNEQPVVRVNRAXARRAGNADKLIGSAMRLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 39628 - DNA, 747 bp, Neisseria meningitidis
ttttcaaacccggcagtttgggcggttttgtggctgawgtttgccgtccgccccgcccttgccgacgagttgaccaacctgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 39629 - protein, 248 aa, Neisseria meningitidis
  misc_feature (13)..(13): Xaa can be any naturally occurring amino acid
FSNPAVWAVLWLXFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 39630 - DNA, 843 bp, Neisseria meningitidis
  misc_feature (160)..(160): n is a, c, g, or t
  misc_feature (247)..(247): n is a, c, g, or t
  misc_feature (277)..(277): n is a, c, g, or t
  misc_feature (656)..(656): n is a, c, g, or t
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccatcaaccgancccccgcccggcgggcgggcaatgccgacgaactcatcggcagcgcgatggggcttaacgaacagcccgttttacccgtcaaccgantccccgcccggcgggcgggcaatgccgacnaactcatcggcaacgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcgatttctaccggttttgactgcagcggcttcatgcagcacatcttcaaacgcgccatgggcatcaacctgccgcgcacgtcggcagaacaggcgcggatgggtacgccggttgcccgaagcgaattgcagcccggggatatggtgtntttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 39631 - protein, 280 aa, Neisseria meningitidis
  misc_feature (54)..(54): Xaa can be any naturally occurring amino acid
  misc_feature (83)..(83): Xaa can be any naturally occurring amino acid
  misc_feature (93)..(93): Xaa can be any naturally occurring amino acid
  misc_feature (219)..(219): Xaa can be any naturally occurring amino acid
MDSFFKPAVWAVLWLMFAVRPALADELTNLLSSREQILRQFAEDEQPVLPINRXPARRAGNADELIGSAMGLNEQPVLPVNRXPARRAGNADXLIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVXFRTLGGSRISHVGLYIGNNRFIHAPRTGKNIEITSLSHKYWSGKYAFARRVKKNDPSRFLN

SEQ ID NO: 39632 - DNA, 669 bp, Neisseria gonorrhoeae; identical to SEQ ID NO: 39626
  misc_feature (250)..(250): n is a, c, g, or t

SEQ ID NO: 39633 - protein, 222 aa, Neisseria gonorrhoeae; identical to SEQ ID NO: 39627
  misc_feature (84)..(84): Xaa can be any naturally occurring amino acid

SEQ ID NO: 39634 - DNA, 756 bp, Neisseria meningitidis
atggattcttttttcaaaccggcagtttgggcggttttgtggctgatgtttgccgtccgccccgcccttgccgacgagttgaccaacytgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 39635 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 39636 - DNA, 843 bp, Neisseria meningitidis; identical to SEQ ID NO: 39630
  misc_feature (160)..(160): n is a, c, g, or t
  misc_feature (247)..(247): n is a, c, g, or t
  misc_feature (277)..(277): n is a, c, g, or t
  misc_feature (656)..(656): n is a, c, g, or t

SEQ ID NO: 39637 - protein, 280 aa, Neisseria meningitidis; identical to SEQ ID NO: 39631
  misc_feature (54)..(54): Xaa can be any naturally occurring amino acid
  misc_feature (83)..(83): Xaa can be any naturally occurring amino acid
  misc_feature (93)..(93): Xaa can be any naturally occurring amino acid
  misc_feature (219)..(219): Xaa can be any naturally occurring amino acid

SEQ ID NO: 39638 - DNA, 597 bp, Neisseria gonorrhoeae
atgagcgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgattttcggctgaaacccgccgtcgtcgtgcttgccgtgccgctctaccaaaaccgccgtaaaatcttcaaccagtggctgcccgtcatcgtttcgcagcttgcgggcagcgttacgggcattgttacggggatgtattttgccgcttggctcgggccggatacccaattctccttcccgcctcgtcttcaatatctgttatttacaccctctggaatcccaattcacaccctgtatgcgcgggttctcccgccatttctgttgcctccgcctctcctgccgcgcctcggcccgcatacattgcgccggttcacaatacttccaaaaaaactacggccgtttaagcccctcctcccagttgtggtcctttctcctccgggcctcgcccctcccctcttataa

SEQ ID NO: 39639 - protein, 198 aa, Neisseria gonorrhoeae
MSEILRQPSVLLFLTLAVYALAIIVRTRTGNIFCNPVLVSTIVLIAYLKILGIDYAVYHNAAQFIDFRLKPAVVVLAVPLYQNRRKIFNQWLPVIVSQLAGSVTGIVTGMYFAAWLGPDTQFSFPPRLQYLLFTPSGIPIHTLYARVLPPFLLPPPLLPRLGPHTLRRFTILPKKLRPFKPLLPVVVLSPPGLAPPLL

SEQ ID NO: 39640 - DNA, 693 bp, Neisseria meningitidis
atgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttga

SEQ ID NO: 39641 - protein, 230 aa, Neisseria meningitidis
MNEILRQPSVLLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 39642 - DNA, 693 bp, Neisseria meningitidis
atgaacgaaatcctcaggcagccgagcatcctgcttttcctcacgcttgccgtgtacgcgcttgcgattatcgtgcgcacgcgcacgggtaatatcttctgcaaccccgtactcgtcagcactatcgtgctgattgcctacctgaaaatcctcggtatcgattatgcggtgtaccacaacgccgcgcagtttatcgatttctggctcaagcccgccgtcgtcgtgcttgccgtgccgctctaccaaaaccgccgtaaaatcttcaaccaatggctgcccgtcatcgtttcgcagcttgcgggcagcgttacgggcattgttacggggatgtattttgccaaatggctgggcgcggaacgcgaagtcgtcctctcgctcgcgtccaaatctgttaccaatcctatcgccatcgaaatcacccgctccatcggcggcattcccgccattaccgccgccaccgtcatcattgccggcctggtcggacagattgccggttacaaaatgttgaaaaacacggtcgttatgccctcatctgtcggaatgtcgctcggcacggcttcgcacgcgatgggcattgccgcctcgctcgaacgcagccgccgcatggcggcatacgcggggctggggctgacgttcaacggcgtactgaccgcgctgattgcgccgctgcttatccccgttttgggattttga

SEQ ID NO: 39643 - protein, 230 aa, Neisseria meningitidis
MNEILRQPSILLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 39644 - DNA, 345 bp, Neisseria gonorrhoeae
atgaacatcatccgcgcgctcctcatcatcctcggctgcctcgccgccggcgaaaccgccgttttcctagcaggcatcaaactgcccggcagcatcgtcggcatgggcgtgctgtttgcgcttttgcaggcgggttggctcaaaacgtcttggctgcaacagcttaccgacgcgctgatggcaaacctgacgctgttcctcgtgccgccctgcgtggcggtcatcagctatttggatttgattgccgacgattggttttcgatactggtttccgcctccgccagcactttgtgcgtactgctggttacgggcaaggttcaccgctggatacggagcattatctga

SEQ ID NO: 39645 - protein, 114 aa, Neisseria gonorrhoeae
MNIIRALLIILGCLAAGETAVFLAGIKLPGSIVGMGVLFALLQAGWLKTSWLQQLTDALMANLTLFLVPPCVAVISYLDLIADDWFSILVSASASTLCVLLVTGKVHRWIRSII

SEQ ID NO: 39646 - DNA, 203 bp, Neisseria meningitidis
acgtcttkgctgcaacagcttaccgacgcgctgatgtcgaacctgacgctgttcctcgtgccgcctgcgtggcggtcatcagctatttggatttgattgccgacgattggttttcgatactggtttccgcctccgccagcactttgtgcgtactgctggttacgggcaaagtccaccggtggatacggggtattatccgatga

SEQ ID NO: 39647 - protein, 67 aa, Neisseria meningitidis
  misc_feature (3)..(3): Xaa can be any naturally occurring amino acid
TSXLQQLTDALMSNLTLFLVPPCVAVISYLDLIADDWFSILVSASASTLCVLLVTGKVHRWIRGIIR

SEQ ID NO: 39648 - DNA, 345 bp, Neisseria meningitidis
atgaacatcatccgcgcgctcctcatcatcctcggctgcctcgccaccggcgaaaccgccgttttcctagcaggcatcaaactgcccggcagcatcgtcggcatgggcgtactgtttgcgcttttgcaggcgggttgggtcaaaacgtcttggctgcaacagcttaccgacgcgctgatggcgaatctgacgttgtttctcgtgccgccctgcgtggcggtcatcagctatttggatttgattgccgacgattggttttcgatactggtttccgcctccgccagcactttgtgcgtactgctggttacaggcaaggttcaccgctggatacggagcattatctga

SEQ ID NO: 39649 - protein, 114 aa, Neisseria meningitidis
MNIIRALLIILGCLATGETAVFLAGIKLPGSIVGMGVLFALLQAGWVKTSWLQQLTDALMANLTLFLVPPCVAVISYLDLIADDWFSILVSASASTLCVLLVTGKVHRWIRSII

SEQ ID NO: 39650 - DNA, 324 bp, Neisseria meningitidis
atgaaaaaattattgattgccgcaatgatggcggctgccttggcagcttgttcgcaagaagccaaacaggaggttaaggaagcggttcaagccgttgagtccgatgttaaagacactgcggcttctgccgccgagtctgccgcttctgccgtcgaagaagcgaaagaccaagtcaaagatgctgcggctgatgcaaaggcaagtgccgaggaagctgtaactgaagccaaagaagctgtaactgaagcagctaaagatactttgaacaaagctgccgacgcgactcaggaagcggcagacaaaatgaaagatgccgccaaataa

SEQ ID NO: 39651 - protein, 107 aa, Neisseria meningitidis
MKKLLIAAMMAAALAACSQEAKQEVKEAVQAVESDVKDTAASAAESAASAVEEAKDQVKDAAADAKASAEEAVTEAKEAVTEAAKDTLNKAADATQEAADKMKDAAK

SEQ ID NO: 39652 - DNA, 324 bp, Neisseria meningitidis; identical to SEQ ID NO: 39650

SEQ ID NO: 39653 - protein, 107 aa, Neisseria meningitidis; identical to SEQ ID NO: 39651

SEQ ID NO: 39654 - DNA, 591 bp, Neisseria gonorrhoeae
atggctgccgtatcgggcggcggtgcggtcttcctgataatgcttccacatattgcccgcgttcagcgtcagccgccagcgttcgcccaagcgtcgggagaaatcggcattgaagccgccggcgaaattgtatcggctgccgcccaagaggttttgcccgacaaacggcacggtgccgaacgagcgcgttaccgaacggttttgatggccgaacgacaggcgcaggttctgttcgctgaaatctttgttatcccaataatgcacgccgcggctgatgccgccgtagaggaaatgatgcccgcccgcattgatttcgcgcgacacgcccaagccgtagcgcaaaccgtgtgccttttgcggcaggctgtcggcggttttcgtccagcttctgcccgcaaattcaatcgttttttcggacgaagcgttgtttatagcggattaacaaaaatcaggacaaggcggcgggccgcaggcagtacggatggtacggaaccggttcgcccggtgcttggacgccttagggaaccgttccctttgagccggggcggggcaacccgtaccggtttttgttcatccgccatattgtgttga

SEQ ID NO: 39655 - protein, 196 aa, Neisseria gonorrhoeae
MAAVSGGGAVFLIMLPHIARVQRQPPAFAQASGEIGIEAAGEIVSAAAQEVLPDKRHGAERARYRTVLMAERQAQVLFAEIFVIPIMHAAADAAVEEMMPARIDFARHAQAVAQTVCLLRQAVGGFRPASARKFNRFFGRSVVYSGLTKIRTRRRAAGSTDGTEPVRPVLGRLREPFPLSRGGATRTGFCSSAILC

SEQ ID NO: 39656 - DNA, 482 bp, Neisseria meningitidis
gctcaagcgttgggagaaatcggcattgaagccgccgacgaaattgtatcggctgccgcctaagaggttttgctcgacaaacggcacgatgccgaacgagcgcgttaccgaacggtttttatagccgaacgacaggcgcaggctctgttcgctgaaatctttgttatcccaataatgcacgccgccgccgctgatgccgccgtagaggaaatgatgcctgcccgcattgatttcgcgcgacacgcctaagccctagcgcaaaccgtgtgccttttgcggcaggctgtcggcggttttcgtccagcttctgcccgcaaattcaatcgttttttcggacgaagcgttgtttatagcggattaacaaaaatcaggacaaggcaacgaagccgcagacagtacaaatagtacggaaccgattcacttggtgcttcagcaccttagagaatcgttctcttttttgttcatccgctatattgtgttga

SEQ ID NO: 39657 - protein, 160 aa, Neisseria meningitidis
  misc_feature (21)..(21): Xaa can be any naturally occurring amino acid
  misc_feature (83)..(83): Xaa can be any naturally occurring amino acid
AQALGEIGIEAADEIVSAAAXEVLLDKRHDAERARYRTVFIAERQAQALFAEIFVIPIMHAAAADAAVEEMMPARIDFARHAXALAQTVCLLRQAVGGFRPASARKFNRFFGRSVVYSGLTKIRTRQRSADSTNSTEPIHLVLQHLRESRSLFCSSAILC

SEQ ID NO: 39658 - DNA, 583 bp, Neisseria meningitidis
atggctgtcgtatcgggcggcggtgcggtcttcctgataacgcttccacatattgcccacgttcagcgtcagccgccagttcgctcaagcgtcgggagaaatcggcattgaagccgccgacgaaattgtatcggctgccgcctaagaggttttgctcgataaacggcacgatgccgaatgagcgcgttactgaacggtttttatagccgagcgacaggcgcaggctctgttcgctgaaatctttgttatcctaatagtgcacgccgccgccgctgatgtctccgtagaggaaatgatgcccgcccgcattgatttcgcgcgacacgcccaagccgtagcgcaaaccgtgtgccttttgcggcaggctgtcggcggttttcgtccagcttctgcctgcaaattcaatcgttttttcggacgaagcgttgtttatagcggattaacaaaaatcaggacaaggcgacgaagcgcagacagtacagatagtacggaaccgattcacttggtgcttcagcaccttagagaatcgtctctttgagctaaggcgaggcaacgccgtactggtttttgttcatccactata

SEQ ID NO: 39659 - protein, 191 aa, Neisseria meningitidis
  misc_feature (27)..(27): Xaa can be any naturally occurring amino acid
MAVVSGGGAVFLITLPHIAHVQRQPPXFAQASGEIGIEAADEIVSAAAEVLLDKRHDAEARYTVFIAERQAQALFAEIFVILIVHAAAADVSVEEMMPARIDFARHAQAVAQTVCLLRQAVGGFRPASACKFNRFFGRSVVYSGLTKIRTRRRSADSTDSTEPIHLVLQHLRESSLAKARQRRTGFCSSTI

SEQ ID NO: 39660 - DNA, 1173 bp, Neisseria gonorrhoeae
atgttccattccatcgaaaaatacagaacacccgcccaagtcttattaggcctgattgcattaacttttgtcggcttcggcgtcagcacggtttcccatccgggcgccgactacatcgtccaagtgggcgacgaaaaaatcagcgagcactcaatcaacaacgccatgcagaacgagcaggcggacggcggcagcccttggcgcgacgcggtgttccaatccctgctgcaacgcgcctacctgaaacagggcgcgaagctgatgggcatttcggtttcttccgaacaaatcaagcagatgattgtggacgatcccaatttccacgacgcaaacggcaaattcagtcacgcgcttttgagtcaatacctgtcgcaacgccatatgtctgaagaccagtttgtcgaagaaatccgcgatcagtttgccttgcagaatttggtaagcctcgtccaaaacggcgtattggtcggcgacgcgcaggcggaacagctgatcaggctgacgcaggtcaaccgcaccatccgttcgcacactttcaaccccgacgagttcatcgcccaagtcaaagcgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcgtttgaagagcgcgtggcgcgtttgccggcacatgaagccaaaccttctttcgagcaggaaaaagccgccgtcgaaaacgaattgaaaatgaaaaaggcggttgccgacttcaacaaggcaaaagaaaagctgggcgacgatgcgttcaatcatccctcctcgcttgccgaagccgccaaaaacagcggtttgaaagtggaaacccaagaaacttggctgagcaggcaggacgcacaaatgtccggcatgcccgaaaacctaatcaatgccgtattcagcgacgacgtattgaagaaaaaacacaattccgaagtgctgaccatcaacagcgaaaccgcgtgggtcgtccgcgccaaagaagtccgcgaagaaaaaaacctactgtttgaagaagccaaagatgcggtgcgtcaggcctatatccgtaccgaagccgccaaacttttgaaaacaatgtaa

SEQ ID NO: 39661 - protein, 390 aa, Neisseria gonorrhoeae
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLLKTM

SEQ ID NO: 39662 - DNA, 1156 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgccgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgtcaaccatccttcytcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaactt

SEQ ID NO: 39663 - protein, 386 aa, Neisseria meningitidis
MFHSIEKYRTPAQVLLGLIALTFVGFGVSTVSHPGADYIVQVGDEKISDHSINNAIQNEQADGGGPSPDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAVNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 39664 - DNA, 1158 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctacaacgcgcctacctgaaacagggcgcgaagctgatgggcatttcggtttcttccgaacaaatcaagcagattatcgtggacgatcccaatttccacgacgcaaacggcaaattcgaccacgcgcttttaaaccgctacctttcccaacgtcatatgtctgaagaccagtttgtcgaagaaatccgcgatcagtttgccttgcagaatttggtaaacctcgtccaaaacggcgtattggtcggcgacgcgcaggcggaacagctgatcaggctgacgcaggtcaaccgcaccatccgttcgcacactttcaaccccgacgaattcatcgcccaagtcaaagtgtctgaagccgatttgcagaagttttataacgcaaacaaaaaagactacctgcttcccaaagcggtcaaattggaatatgtcgccttgaatctgaaagactttgcagacaaacagaccgtcagcgaaacagaagtgaaaaatgcgtttgaagagcgcgtggcgcgtttgccggcaaatgaagccaaaccttctttcgagcaggaaaaagccgccgtcgaaaacgaattgaaaatgaaaaaggcggttgccgacttcaataaggcaaaagaaaagctgggcgatgacgcgttcaaccatccttcctcgcttgccgaagccgccaaaaacagcggtttgaaagtcgaaacccaagaaacttggctgagcaggcaggatgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaactt

SEQ ID NO: 39665 - protein, 386 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 39666 - DNA, 1539 bp, Neisseria gonorrhoeae
atgttccattccatcgaaaaatacagaacacccgcccaagtcttattaggcctgattgcattaacttttgtcggcttcggcgtcagcacggtttcccatccgggcgccgactacatcgtccaagtgggcgacgaaaaaatcagcgagcactcaatcaacaacgccatgcagaacgagcaggcggacggcggcagcccttggcgcgacgcggtgttccaatccctgctgcaacgcgcctacctgaaacagggcgcgaagctgatgggcatttcggtttcttccgaacaaatcaagcagatgattgtggacgatcccaatttccacgacgcaaacggcaaattcagtcacgcgcttttgagtcaatacctgtcgcaacgccatatgtctgaagaccagtttgtcgaagaaatccgcgatcagtttgccttgcagaatttggtaagcctcgtccaaaacggcgtattggtcggcgacgcgcaggcggaacagctgatcaggctgacgcaggtcaaccgcaccatccgttcgcacactttcaaccccgacgagttcatcgcccaagtcaaagcgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcgtttgaagagcgcgtggcgcgtttgccggcacatgaagccaaaccttctttcgagcaggaaaaagccgccgtcgaaaacgaattgaaaatgaaaaaggcggttgccgacttcaacaaggcaaaagaaaagctgggcgacgatgcgttcaatcatccctcctcgcttgccgaagccgccaaaaacagcggtttgaaagtggaaacccaagaaacttggctgagcaggcaggacgcacaaatgtccggcatgcccgaaaacctaatcaatgccgtattcagcgacgacgtattgaagaaaaaacacaattccgaagtgctgaccatcaacagcgaaaccgcgtgggtcgtccgcgccaaagaagtccgcgaagaaaaaaacctactgtttgaagaagccaaagatgcggtgcgtcaggcctatatccgtaccgaagccgccaaacttgccgaaaacaaggcaaaagaagtgcttacccaactgaacggcggcaaggcagttgacgtgaaatggtcggaagtgtccgttttgggcgcgcagcaggcaaggcagtccatgccgcccgaggcttatgcggaactgctgaaagcaaaaccggcaaacggcaaacccgcctatgtcagactgaccggtctgccggcacccgtgattgtcgaggcgcaggcagtcacgcctccggaggatattgccgcacagcttcctcctgcgaaacaggctttggcgcaacagcagtctgccaatactttcgacctgctgatccgctatttcaacggaaaaatcaaacagactaaaggagcacaatcggttgacaacggcgatggtcagtaa

SEQ ID NO: 39667 - protein, 512 aa, Neisseria gonorrhoeae
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLAENKAKEVLTQLNGGKAVDVKWSEVSVLGAQQARQSMPPEAYAELLKAKPANGKPAYVRLTGLPAPVIVEAQAVTPPEDIAAQLPPAKQALAQQQSANTFDLLIRYFNGKIKQTKGAQSVDNGDGQ

SEQ ID NO: 39668 - DNA, 1539 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgttcaaccatccttcctcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaa

SEQ ID NO: 39669 - protein, 512 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 39670 - DNA, 1539 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctacaacgcgcctacctgaaacagggcgcgaagctgatgggcatttcggtttcttccgaacaaatcaagcagattatcgtggacgatcccaatttccacgacgcaaacggcaaattcgaccacgcgcttttaaaccgctacctttcccaacgtcatatgtctgaagaccagtttgtcgaagaaatccgcgatcagtttgccttgcagaatttggtaaacctcgtccaaaacggcgtattggtcggcgacgcgcaggcggaacagctgatcaggctgacgcaggtcaaccgcaccatccgttcgcacactttcaaccccgacgaattcatcgcccaagtcaaagtgtctgaagccgatttgcagaagttttataacgcaaacaaaaaagactacctgcttcccaaagcggtcaaattggaatatgtcgccttgaatctgaaagactttgcagacaaacagaccgtcagcgaaacagaagtgaaaaatgcgtttgaagagcgcgtggcgcgtttgccggcaaatgaagccaaaccttctttcgagcaggaaaaagccgccgtcgaaaacgaattgaaaatgaaaaaggcggttgccgacttcaataaggcaaaagaaaagctgggcgatgacgcgttcaaccatccttcctcgcttgccgaagccgccaaaaacagcggtttgaaagtcgaaacccaagaaacttggctgagcaggcaggatgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaa

SEQ ID NO: 39671 - protein, 512 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 39672 - DNA, 906 bp, Neisseria gonorrhoeae
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaggccgtgcggtgtctttaccaaatgcccaaccattcgcccacggaatccatccaatccttattgcccccgccgctcctgcctgcccggcggtacgcccacggcgcttgcggatttttagctttccacaatcctttgcgttccctttccgcctgaatttgagcgtcggcatagtcggcaaaatccgccttatcctgctgttctttagcataacttttataatgccacgccgccccgtcctgcacctgcatcaggttcaaatcggttttgccggcggatacctgcgccacttcgcgctgatagcggtcggtttcaaacacacgtacactgactttcctaccctccgccgccgcgcgcaggttgtcgcgcgaacgtgtaccgtaagcctgtttcatctccggtgcgtcgatatacgccatccgaattttatgtttcgcgccgtcgccgtcgatgacgtgaagggtatcgccgtcatagactttggacaccgtgcctgtgtagctgtggccggatttcgccgatgcccgtcggcgaacgggcgcgtcgaaacccacgtcccctgcagtgccgagtacgtcgagtacggcaaccgccgtccgcaccgcctcactgtcatatcccgtataacccaacgcgcccaaaagcgacagggcgacgggaagccatttcatgatttttttaatctgcatatttttcaaatgccgatgccgtctgaacatctctga

SEQ ID NO: 39673 - protein, 301 aa, Neisseria gonorrhoeae
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYTDFPTLRRRAQVVARTCTVSLFHLRCVDIRHPNFMFRAVAVDDVKGIAVIDFGHRACVAVAGFRRCPSANGRVETHVPCSAEYVEYGNRRPHRLTVISRITQRAQKRQGDGKPFHDFFNLHIFQMPMPSEHL

SEQ ID NO: 39674 - DNA, 222 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcggc

SEQ ID NO: 39675 - protein, 74 aa, Neisseria meningitidis
MSKRKSINRPYQKPAELPPLQNNPPFYRKNRRLNFFIAADGGCASPQKCRARGFQTAFAVQSRAVSLPNAQPFG

SEQ ID NO: 39676 - DNA, 903 bp, Neisseria meningitidis
  misc_feature (113)..(113): n is a, c, g, or t
atgtcaaaacgaaaatccataaaccgtccgtatcaaaaaccggcggaactgccgccgttgcaaaataatccgccattttaccgtaaaaaccgccgcctgaacttttttatcgnggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgcccggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtgtcgaacacgcggacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacaaggcgacgggaagccatttcatgatttttttaatctgcatatttttcaaatgccgatgccgtctgaacatatc

SEQ ID NO: 39677 - protein, 301 aa, Neisseria meningitidis
  misc_feature (38)..(38): Xaa can be any naturally occurring amino acid
MSKRKSINRPYQKPAELPPLQNNPPFYRKNRRLNFFIXADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHI

SEQ ID NO: 39678 - DNA, 699 bp, Neisseria gonorrhoeae
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaggccgtgcggtgtctttaccaaatgcccaaccattcgcccacggaatccatccaatccttattgcccccgccgctcctgcctgcccggcggtacgcccacggcgcttgcggatttttagctttccacaatcctttgcgttccctttccgcctgaatttgagcgtcggcatagtcggcaaaatccgccttatcctgctgttctttagcataacttttataatgccacgccgccccgtcctgcacctgcatcaggttcaaatcggttttgccggcggatacctgcgccacttcgcgctgatagcggtcggtttcaaacacacgtacaatgagtttcgtaccctccgccgccgcgcgcaggttgtcgcgcgaacgtgtaccgtaagcgtgtttcatctccggtgcgtcgatatacgccatccgaattttatgtttcgcgccgtcgccgtcgatgacgtgaagggtatcgccgtcatagactttggacaccgtgcctgcgtagctgtggccggatttcgc

SEQ ID NO: 39679 - protein, 233 aa, Neisseria gonorrhoeae
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYNEFRTLRRRAQVVARTCTVSVFHLRCVDIRHPNFMFRAVAVDDVKGIAVIDFGHRACVAVAGFR

SEQ ID NO: 39680 - DNA, 930 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaa

SEQ ID NO: 39681 - protein, 309 aa, Neisseria meningitidis
MSKRKSINRPYQKPAELPPLQNNPPFYRKNRRLNFFIAADGGCASPQKCRARGFQTAFAVQSRAVSLPNAQPFAHGIHPILIAPAAPACSAVRPRRLRIFSFPQSFAFPFRLNLSVGIIGKIRLILLFFSITFIMPRRPVLHLHQVQIGFADRNLRHFALVAVGIEHAHADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 39682 - DNA, 930 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgcccggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtgtcgaacacgcggacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacaaggcgacgggaagccatttcatgatttttttaatctgcatatttttcaaatgccgatgccgtctgaacatatcggaatcggatttcagacggcatcttaa

SEQ ID NO: 39683 - protein, 309 aa, Neisseria meningitidis
MSKRKSINRPYQKPAELPPLQNNPPFYRKNRRLNFFIAADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 39684 - DNA, 873 bp, Neisseria gonorrhoeae
atgatgggcaacagcctgattgaatccggtacgtttgtcgccatcctgtttggtcagattttgggaacggcggttgccggcgcgccgccttatattgtcgggatactggttttgctggtcgccgtcggaggaacggccggcagcctgtttatgccgtccgtacccgccaaggctgccgatacccaaatcgagtggaatattgtccgtggtacaaaatccctgctgcgtgaaacggtgcggcacaatcccgtttttaccgccattatcggcatctcgtggttttggtttgtcggcgcggtttataccacgcaactgccgacctttacccaaatccatttgggcggcaacgataatgtttttaacctgatgcttgctttgttttccatcggtattgccgccggttcggtactgtgtgccaagttcggcagggaacggctgatgttggcttgggtaacggttggtgcgttgggttcgacggtttgcggcctggttttggtgtggctgacgcacggacaccgttttgaagggctgaacggcattttttggtttttatcgcaaggatgggcataccccgtgatggcggtgatgacgctgatcggctttttcggcggatttttctccgttccgctctatacctggctgcaaaccgccagcagcgagactttccgcgcccgcgccgttgccgccaacaatatcgttaacggcatctttatggtttccgccgccgttttgagcgcggtattgctgtttttgtttgacagcatttccctgctgtatctgattgtcgccttgggcaatattccgttggcggtatttttgattaagcgcgaaaggcggtttttaggcgcggcggcaatcaggaaaaaaccttga

SEQ ID NO: 39685 - protein, 290 aa, Neisseria gonorrhoeae
MMGNSLIESGTFVAILFGQILGTAVAGAPPYIVGILVLLVAVGGTAGSLFMPSVPAKAADTQIEWNIVRGTKSLLRETVRHNPVFTAIIGISWFWFVGAVYTTQLPTFTQIHLGGNDNVFNLMLALFSIGIAAGSVLCAKFGRERLMLAWVTVGALGSTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLAVFLIKRERRFLGAAAIRKKP

SEQ ID NO: 39686 - DNA, 868 bp, Neisseria meningitidis
atgatgggcaacagcctgattgaatcgggtacgtttgtcgccatcctgttcggtcagattttgggaacggcggtggcaggtgtaccgccttatattgtcgggatactggttttgctggtcgccgtcggaggcacggtcggcagcctgtttatgccgtccgtacccgccaaggctgccgatacacaaattgagtggaatattgtccgtggcacaaaatccctgctgcgtgaaacggtgcggcacaagcccgtttttaccgccattatcggtatttcgtggttttggtttgtcggcgcggtttataccacgcaactgccgacctttacccaaatccatctgggcggcaacgacaatgttttcaacctgatgcttgctctgttttccatcggtattgccgccggttcggtactgtgtgccaagttcagcakggaacgcctgatgttggcttgggtaacggttggtgcgttgggtttgacggtttgcggcttggttttggtgtggctgacgcacggacaccgttttgaagggctgaacggcattttttrgtttttatcgcaaggatgggcatatcccgtgatggcggtgatgacgctgatcggctttttcggcggatttttctccgttccgctctatacctgtgcaaaccgccatagcgagatttccgcgcccggccgttgccgccaacaatatcgttaacggtatttttatggtttccgctgccgttttgagcgcggtgttgctgtttttgtttgacagcatttccttgttgtatctgattgtcgctttgggcaatattccgttgtcggtatttttgattaagcgcgaaaggcggtttttaggcgcggcggcaatcaggaaaaaaccttga

SEQ ID NO: 39687 - protein, 288 aa, Neisseria meningitidis
  misc_feature (143)..(143): Xaa can be any naturally occurring amino acid
  misc_feature (182)..(182): Xaa can be any naturally occurring amino acid
MMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSXERLMLAWVTVGALGLTVCGLVLVWLTHGHRFEGLNGIFXFLSQGWAYPVMAVMTLIGFFGGFFSVPLYTVQTAIARFPRPAVAANNIVNGIFMVSAAVLSAVLLFLFDSISLLYLIVALGNIPLSVFLIKRERRFLGAAAIRKKP

SEQ ID NO: 39688 - DNA, 1311 bp, Neisseria meningitidis
atgtacgctaaaaaaggcggtttgggactggttaaaagccgccgtttcgcacctcttttcgctacgcagtttctcggcgcgttcaacgacaatgtgttcaaaaccgcgctgtttgtgatgattgggttttacggtttggggcaaaacggcttcctgcctgccggacagatgttgaacttgggcgcgttgctgtttattttgccgtatttcctgttttcctcgctgtcggggcagttgggtaacaaattcgacaaggccgttttggcgcgttgggccaaggtgctggaaatgatcattatggcggtggcggcatacgggttttatatccggtctgccccgctgcttttggcgtgtctgttttgcatgggcgcgcaatcgacgctgttcgggccgctgaaatacgccatcctgcccgattatctcgacgacaaagagttgatgatgggcaacagcctgattgaatcgggtacgtttgtcgccatcctgttcggtcagatactggggactgcggtggcaggtgtaccgccttatattgtcgggatactggttttgctggtcgccgtaggaggcacggtcggcagcctgtttatgccgtccgtacccgccaaggctgccgatacacaaattgagtggaatattgtccggggtacaaaatccctgctgcgtgaaacggtgcggcacaagcccgtttttaccgccattatcggtatttcgtggttttggtttgtcggcgcggtttataccacgcaactgccgacctttacccaaatccatctaggcggcaacgacaatgttttcaacctgatgcttgccctgttttccatcggtattgccgccggttcggtactgtgtgccaagttcagcagggaacggctgaggttggcttgggtaacggttggtgcgttgggtttgacggtttgcggcttggttttggtgtggctgacgcacggacaccgttttgaagggctgaacggcattttttggtttttatcgcaaggatgggcatatcccgtgatggcggtgatgacgctgatcggctttttcggcggatttttctccgttccgctctatacctggctgcaaaccgccagtagcgagactttccgcgcccgcgccgttgccgccaacaatatcgttaacggtatttttatggtttccgctgccgttttgagcgcggtgttgctgtttttgtttgacagcatttccttgttgtatctgattgtcgctttgggcaatattccgttgtcggtatttttgattaagcgcgaaaggcggtttttaggcgcggcggcaatcaggaaaaaaccttga

SEQ ID NO: 39689 - protein, 436 aa, Neisseria meningitidis
MYAKKGGLGLVKSRRFAPLFATQFLGAFNDNVFKTALFVMIGFYGLGQNGFLPAGQMLNLGALLFILPYFLFSSLSGQLGNKFDKAVLARWAKVLEMIIMAVAAYGFYIRSAPLLLACLFCMGAQSTLFGPLKYAILPDYLDDKELMMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSRERLRLAWVTVGALGLTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLSVFLIKRERRFLGAAAIRKKP

SEQ ID NO: 39690 - DNA, 690 bp, Neisseria gonorrhoeae
atgaaacgcaaaaatatcgcgctgattcccgccgccggcatcggggtgcgtttcggtgcggacaaacccaagcaatatgtcgaaatcggaagcaaaaccgttttagaacatgtacttgggatttttgaacggcatgaggccgtcgatttgaccgtcgttgtcgtctcgcccgaagacacgtttgccgataaggttcagacggcatttccacaggttcgggtgtggaaaaacggtggacagacccgcgccgaaactgtccgcaacggtgtggcaaaactgttggaaaccggtttggcggcggaaaccgacaatattctggtacacgatgccgcccgctgctgcctgccgtctgaagctctggcgcggttgatagaacaggcgggcaacgccgccgaaggcgggattttggcagttcccgttgccgatacgctcaagcgcgcagaaagcggacaaatcagtgcaactgtcgaccgttcggggctttggcaggcgcaaacgccgcagctttttcaagcgggtttgctgcaccgcgcattggctgcggaaaacttgggcggcattaccgatgaagcgtccgccgtggaaaaactgggtgtgcgtccgctactgatacagggcgacgcgcgcaatttgaaactgacgcagccgcaggacgcatacatcgtcaggctgctgctcaatgccgtctga

SEQ ID NO: 39691 - protein, 229 aa, Neisseria gonorrhoeae
MKRKNIALIPAAGIGVRFGADKPKQYVEIGSKTVLEHVLGIFERHEAVDLTVVVVSPEDTFADKVQTAFPQVRVWKNGGQTRAETVRNGVAKLLETGLAAETDNILVHDAARCCLPSEALARLIEQAGNAAEGGILAVPVADTLKRAESGQISATVDRSGLWQAQTPQLFQAGLLHRALAAENLGGITDEASAVEKLGVRPLLIQGDARNLKLTQPQDAYIVRLLLNAV

SEQ ID NO: 39692 - DNA, 456 bp, Neisseria meningitidis
atgaagcgcaaaaatatcgcgctgattcccgccgccggcatcggggcgcgtttcggtgcggacaaacccaagcaatatgtcgaaatcggaagcaaaaccgttttagaacatacgattgggatttttgaacggcatgaggccgtcgatttgaccgtcgttgtcgtctcgcccgaagacacgtttgccgataaggttcagacggcatttccacaggttcgggtgtggaaaaacggcggacagacccgcgccgaaaccgtccgcaacggtgtggcaaaactgttggaaaccggtttggcggcggaaaccgacaatattctggtacacgatgccgcgcgttgctgcctgccgtctgaagctttgacgcggttgatagaacaggcgggcaacgccgccgaaggcgggattttggcaattcccattgccgatacgctcaagtgcgcggacggtgggaacatt

SEQ ID NO: 39693 - protein, 152 aa, Neisseria meningitidis
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPIADTLKCADGGNI

SEQ ID NO: 39694 - DNA, 690 bp, Neisseria meningitidis
atgaagcgcaaaaatatcgcgctgattcccgccgccggcatcggggcgcgtttcggtgcggacaaacccaagcaatatgtcgaaatcggaagcaaaaccgttttagaacatacgattgggatttttgaacggcatgaggccgtcgatttgaccgtcgttgtcgtctcgcccgaagacacgtttgccgataaggttcagacggcatttccacaggttcgggtgtggaaaaacggcggacagacccgcgccgaaactgtccgcaacggtgtggcaaaattgttggaaaccggtttggcggcggaaaccgacaatattctggtacacgatgccgcgcgttgctgcctgccgtctgaagctttgacgcggttgatagaacaggcgggcaacgctgccgaaggtgggattttggcaattcccgttgccgatacgctcaagtgcgcggacggtgggaacattagtgcaaccgtcgagcggacgagcctttggcaggcgcaaacgccgcagcttttccgcgccgggctgctgcaccgcgcattggctgcggaaaacttggacggcattaccgatgaagcgtccgccgtggaaaaattgggcatccgccctttgctggtgcagggcgacgcgcgcaatttgaaactgacgcagccgcaggacgcatacatcgtcaggctgctgctcgatgccgtctga

SEQ ID NO: 39695 - protein, 229 aa, Neisseria meningitidis
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPVADTLKCADGGNISATVERTSLWQAQTPQLFRAGLLHRALAAENLDGITDEASAVEKLGIRPLLVQGDARNLKLTQPQDAYIVRLLLDAV

SEQ ID NO: 39696 - DNA, 672 bp, Neisseria gonorrhoeae
atgaaaaccgtttccgccgccatcgcttttgccgccgctgccgtttcactgaccggctgtgcgaccgagtcctcacgcagcctcgaggttgcaaaagtcgcctcctgcaatacgcaatatcacggtgttcgcaccccgatttccgtcggaacattcgacaaccgctccagcttccaaaaaggcattttctccgacagtgaagaccgtctgggcagccaggcaaaaaccatcctggtaacacacctgcaacaaaccaaccgcttcaacgtactgaaccgcaccaaccttagcgcattgaaacaggaatccggcatttccggcaaagcgcagaacctgaaaggcgcagattatgtcgttaccggcgatgtaaccgaattcggacgcagagatgtcggcgatcatcagctcttcggcattttgggtcgcggcaaatcgcaaatcgcctatgcaaaagtggctctgaatatcgtcaacgtcaatacttccgaaatcgtctattccacacagggcgcgggcgaatacgcactttccaaccgcgaaatcatcggtttcggcggcacttccggctacgatgcgactttgaacggcaaagttttagacttggcaatccgcgaagccgtcgacaacttggttcaggctgtcgacaacggcgcatggcaatccaaccgttaa

SEQ ID NO: 39697 - protein, 223 aa, Neisseria gonorrhoeae
MKTVSAAIAFAAAAVSLTGCATESSRSLEVAKVASCNTQYHGVRTPISVGTFDNRSSFQKGIFSDSEDRLGSQAKTILVTHLQQTNRFNVLNRTNLSALKQESGISGKAQNLKGADYVVTGDVTEFGRRDVGDHQLFGILGRGKSQIAYAKVALNIVNVNTSEIVYSTQGAGEYALSNREIIGFGGTSGYDATLNGKVLDLAIREAVDNLVQAVDNGAWQSNR

SEQ ID NO: 39698 - DNA, 164 bp, Neisseria meningitidis
ggcgcgggcgaatacgcactttccaaccgtgaaatcatcggtttcggcggcacttccggctacgatgcgactttgaacggcaaagttttagacttggcaatccgcgaagcgtcaacagcctggttcaggctgttgacaacggcgcatggcaacccaaccgttaa

SEQ ID NO: 39699 - protein, 54 aa, Neisseria meningitidis
GAGEYALSNREIIGFGGTSGYDATLNGKVLDLAIREAVNSLVQAVDNGAWQPNR

SEQ ID NO: 39700 - DNA, 399 bp, Neisseria meningitidis
  misc_feature (83)..(84): n is a, c, g, or t
  misc_feature (113)..(113): n is a, c, g, or t
aaccgcacctatttgaacgcattaaaacaggaatccggcatttccggcaaagcgcataacctgaaaggcgcaaattatgtcgnnaccggcgatgtaaccgaattcggacgcanagatgtcggcgatcatcagctcttcggcattttgggtcgcggcaaatcgcaaatcgcctatgcaaaagtggctctgaatatcgtcaacgtcaatacttccgaaatcgtctattccgcacagggcgcgggcgaatacgcactttccaaccgtgaaatcatcggtttcggcggcacttccggctacgatgcgactttgaacggcaaagttttagacttggcaatccgcgaagccgtcaacagcctggttcaggctgttgacaacggcgcatggcaacccaaccgttaa

SEQ ID NO: 39701 - protein, 132 aa, Neisseria meningitidis
  misc_feature (28)..(28): Xaa can be any naturally occurring amino acid
  misc_feature (38)..(38): Xaa can be any naturally occurring amino acid
NRTYLNALKQESGISGKAHNLKGANYVXTGDVTEFGRXDVGDHQLFGILGRGKSQIAYAKVALNIVNVNTSEIVYSAQGAGEYALSNREIIGFGGTSGYDATLNGKVLDLAIREAVNSLVQAVDNGAWQPNR

SEQ ID NO: 39702 - DNA, 648 bp, Neisseria gonorrhoeae
atgaaacctttgattttagggcttgccgccgtgttggctctgtctgcctgccaagttcgaaaagctcccgacctcgactacacgtcattcaaagaaagcaaaccggcttcaattttggtggttccgccgctgaacgagtcgcctgatgtcaacggcacttgggggatgctggcttcgaccgccgcgccgatttccgaagccggctattacgtctttcccgccgcagtcgtggaggaaaccttcaaagaaaacggcttgaccaatgccgccgatattcacgccgtccggccggaaaaactgcatcaaattttcggcaatgatgcggttttgtacattacggttaccgaatacggcacttcatatcaaattttagacagcgtgacgaccgtatccgccaaagcacggctggtcgattcccgcaacgggaaagagttgtggtcgggttcggccagcatccgcgaaggcagcaacaacagcaacagcggcctgttgggggctttggtcggcgcagtggtcaatcagattgccaacagcctgaccgaccgcggttatcaggtttccaaaaccgccgcatacaacctactgtcgccctattcccgcaacggtatcttgaaaggtccgagattcgtcgaagagcagcccaaataa

SEQ ID NO: 39703 - protein, 215 aa, Neisseria gonorrhoeae
MKPLILGLAAVLALSACQVRKAPDLDYTSFKESKPASILVVPPLNESPDVNGTWGMLASTAAPISEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSRNGILKGPRFVEEQPK

SEQ ID NO: 39704 - DNA, 648 bp, Neisseria meningitidis
atgaaacctttgattttagggcttgccgccgtgttggcgctgtctgcctgccaagttcaaaaagcgcccgatttcgactacacgtcattcaaggaaagcaaaccggcttcaattttggtggttccgccgctgaacgaatcgcccgatgtcaacggaacatggggtgtactggcttcgaccgccgcgccgctttccgaagccggctattacgtcttccccgccgcagtcgtggaggaaaccttcaaacaaaacggcttgaccaatgccgccgatattcacgccgtccggccggaaaaactgcatcagattttcggcaatgatgcggttttgtacattacggttaccgaatacggcacttcatatcaaattttagacagcgtgacgaccgtatccgccaaagcacggctggtcgattcccgcaacggaaaagagttgtggtcgggttcggccagcatccgcgaaggcagcaacaacagcaacagcggcctgttgggggctttggtcagcgcagtggtcaatcagattgccaacagcctgaccgaccgcggttatcaggtttccaaaaccgccgcatacaacctgctgtcgccctattctcacaacggcatcttgaaaggtccgagattcgttgaagagcagcccaaataa

SEQ ID NO: 39705 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVSAVVNQIANSLTDRGYQVSKTAAYNLLSPYSHNGILKGPRFVEEQPK

SEQ ID NO: 39706 - DNA, 648 bp, Neisseria meningitidis
atgaaacctttgattttagggcttgccgccgtgttggcgctgtctgcctgccaagttcaaaaagcgcccgatttcgactacacgtcattcaaggaaagcaaaccggcttcaattttggtggttccgccgctgaacgaatcgcccgatgtcaacggaacatggggtgtactggcttcgaccgccgcgccgctttccgaagccggctattacgtcttccccgccgcagtcgtggaggaaaccttcaaacaaaacggcttgaccaatgccgccgatattcacgccgtccggccggaaaaactgcatcagattttcggcaatgatgcggttttgtacattacggttaccgaatacggcacttcatatcaaattttagacagcgtgacgaccgtatccgccaaagcacggctggtcgattcccgcaacggaaaagagttgtggtcgggttcggccagcatccgcgaaggcagcaacaacagcaacagcggcctgttgggggctttggtcagcgcagtggtcaatcagattgccaacagcctgaccgaccgcggttatcaggtttctaaaaccgccgcatacaacctgctgtcgccctattctcacaacggcatcttgaaaggtccgagattcgtcgaagagcagcccaaataa

SEQ ID NO: 39707 - protein, 215 aa, Neisseria meningitidis; identical to SEQ ID NO: 39705

SEQ ID NO: 39708 - DNA, 1038 bp, Neisseria gonorrhoeae
atggcgcgtttcgccttctccgccgacattctccgcacagcgtttgcagacggtttcataacctgcaaccgcgcccacatcgcgggtgtaatgccagcagcgttcgcatttttcgccgtcgctggctttggcggcaacggcaagttcatcaccgactttcacttctgctttagacaccagcagggcaaagcgcaattcttcgcccaaagcattcagatagccggccatttcttccggcgcggtaatttcggcttccgcctgcaaggacgaaccgacagttttgtcggcgcgcaaaggctcgatagcggcggttactgcttcgcgcgcttcgcggattgccgtccattttttcaccagttcggcttcggctttttcgttgatggccgggaactcgtgccaagtatggaagaggacgctgtcttcttcgccgccgccgatgatgtcccacgcttcttcgccggtgaagcacaaaatcggtgcaatcaagagaaccaggctgcgcgtgatgtggtacagggcggtttgcgcgctgcggcgggcgcggctgtcggctttggtggtgtagaggcggtctttcaggatgtcgaggtagaacgcgcccaagtcttccgagcagaaagaaacaatgtctttcacggcgaagtggaaggcatagcgcggatagtaaccgcctgccaaacgctcttgcagccgccgcgccaataccaaggcgtagcggtcgatttccaccatatccgcctgttgcacggcatcttcaatcggattaaagtcgctcaaattggcaaacaggaagctcaaggtattgcggatgcggcggtagctttcggtaacgcgtttgaggatttctttggaaatcgccaattcgccgctgtaatcggtggatgccgcccacaggcgcaggatgtccgcgccgaattcgttatagacttcctgcggcgcgacgacgttgccgatggatttcgacattttgcggccgttttggtcaaccacgaaaccgtgggtcagcagctgtttatacggtgcgcgtcccatggatga

SEQ ID NO: 39709 - protein, 345 aa, Neisseria gonorrhoeae
MARFAFSADILRTAFADGFITCNRAHIAGVMPAAFAFFAVAGFGGNGKFITDFHFCFRHQQGKAQFFAQSIQIAGHFFRRGNFGFRLQGRTDSFVGAQRLDSGGYCFARFADCRPFFHQFGFGFFVDGRELVPSMEEDAVFFAAADDVPRFFAGEAQNRCNQENQAARDVVQGGLRAAAGAAVGFGGVEAVFQDVEVERAQVFRAERNNVFHGEVEGIARIVTACQTLLQPPRQYQGVAVDFHHIRLLHGIFNRIKVAQIGKQEAQGIADAAVAFGNAFEDFFGNRQFAAVIGGCRPQAQDVRAEFVIDFLRRDDVADGFRHFAAVLVNHETVGQQLFIRCASHG

SEQ ID NO: 39710 - DNA, 777 bp, Neisseria meningitidis
ttgcacggacgaaccgacggttttgtcggcgcgcaaaggctcgatggcggcggttaccgcttcgcgggcttcgcggattgccgtccattttttcaccagttcggcttcggttttttcgttgatggtcgggaactcgtgccaagtatggaagaggacgctgtcktcttcgccgccgccgwtgaygtcccacgcttcttcgccggtgaagcacaaaatcggtgcaatcaagagaaccaaactgcgtgtgatgtgatacagggcagtttgtgcgctgcggcgtgcatggctgtctgctttggtggtgtagaggcggtctttcaggatgtcgaggtagaacgcacccaagtcttccgagcagaaagaaacartgtcttttacggcaaagtggaakgcataacgcggatagtaatcgcctgccagacactcttgcagctgacgtgccaataccacggcgtagcggtcgatttccaccatatccgcctgttgcacggcatcttcaatcggattaaagtcgctcaagttggcaaacaaaaagctcaaggtattgcggatacggcggtagctttcggttacgcgtttgaggatttctttggaaatcgccaattcgccgctgtaatcggtagatgccgcccacaggcgcaggatgtctgcgccgaattcgttataaacctcttgcggtgcaacgacgttgccgatggatttcgacatttttttgccttcgccgtcgacaacgaaaccatgggtcagcagctgtttatacggcgcgcgacccattga

SEQ ID NO: 39711 - protein, 258 aa, Neisseria meningitidis
  misc_feature (55)..(55): Xaa can be any naturally occurring amino acid
  misc_feature (60)..(60): Xaa can be any naturally occurring amino acid
  misc_feature (123)..(123): Xaa can be any naturally occurring amino acid
  misc_feature (131)..(131): Xaa can be any naturally occurring amino acid
LHGRTDGFVGAQRLDGGGYRFAGFADCRPFFHQFGFGFFVDGRELVPSMEEDAVXFAAAXDVPRFFAGEAQNRCNQENQTACDVIQGSLCAAACMAVCFGGVEAVFQDVEVERTQVFRAERNXVFYGKVEXITRIVIACQTLLQLTCQYHGVAVDFHHIRLLHGIFNRIKVAQVGKQKAQGIADTAVAFGYAFEDFFGNRQFAAVIGRCRPQAQDVCAEFVINLLRCNDVADGFRHFFAFAVDNETMGQQLFIRRATH

SEQ ID NO: 39712 - DNA, 1035 bp, Neisseria meningitidis
atggcgcgtttcgccttctccgccgacattctctgcacagcgtttgcagacggtttcatggcctgcaaccgcgcccacatcgcgggtgtagtgccagcagcgttcgcatttttcaccatcactggctttagcggcaacggcaagttcgctgcctactttcacttctgctttagacaccagcaaagcaaagcgcaattcttcgcccaaagcattcagatagccggccatttcttccggcgcggtaatttcggcttcggcttgcaaggacgaaccgacggttttgtcggcgcgcaaaggctcgatggcggcggttaccgcttcgcgggcttcgcggattgccgtccattttttcaccagttcggcttcggctttttcgttgatggtcgggaactcgtgccaagtatggaaaagcacgctgtcttctgcgccgccgccgatgatgtcccacgcttcttcgccggtgaagcacaaaatcggtgcaatcaagagaaccaggctgcgcgtgatgtggtacagggcggtttgcgcgctgcggcgggcgcggctgtcggctttggtggtatagaggcggtctttcaggatatcgaggtagaacgcgcccaagtcttccgagcagaaagaaaccatttctttcacggcaaagtggaaggcataacgcggataaaaatcaccggcaacgcgttcttgcagccgccttgccaacaccaaggcatagcggtcgatttccaccatatccgcctgttgcacggcatcttcaataggattgaagtcgctcaagttggcaaacaaaaagctcaaggtattgcggatacggcggtagctttcggttacgcgcttgaggatttctttggaaatcgccaattcgccgctgtaatcggtggatgccgcccacaggcgcaggatgtccgcgccgaactcgttatacacttcttgcggcgcgacgacgttgccgatggatttcgacattttgcgcccgttttgatccaccacgaaaccatgggtcagcagctgtttgtacggcgcgcgacccattga

SEQ ID NO: 39713 - protein, 344 aa, Neisseria meningitidis
MARFAFSADILCTAFADGFMACNRAHIAGVVPAAFAFFTITGFSGNGKFAAYFHFCFRHQQSKAQFFAQSIQIAGHFFRRGNFGFGLQGRTDGFVGAQRLDGGGYRFAGFADCRPFFHQFGFGFFVDGRELVPSMEKHAVFCAAADDVPRFFAGEAQNRCNQENQAARDVVQGGLRAAAGAAVGFGGIEAVFQDIEVERAQVFRAERNHFFHGKVEGITRIKITGNAFLQPPCQHQGIAVDFHHIRLLHGIFNRIEVAQVGKQKAQGIADTAVAFGYALEDFFGNRQFAAVIGGCRPQAQDVRAELVIHFLRRDDVADGFRHFAPVLIHHETMGQQLFVRRATH

SEQ ID NO: 39714 - DNA, 1149 bp, Neisseria gonorrhoeae
atgcgggacaaggttggcggtaatatcgcactccccgccccacgaatattcgattctaacatcggcaagctgcggaaaaactttaagcatatcttggcggacaagctcggtcatacgcgcaggattgtcgataaattcgttatccttaccgccgaaaagcagcctgccgtccgcgctgaggcggtaataatccaaaatatggcggttgtcgcatactgccatattgttgcggataagcccttttgtgcgcgcgcccaagggttcggtggcaataataaaggtgctgacggcaatcgccttgcgttccaaaggccggaatatcgggttcaaaccgacataagtattgacggcatagaccacatttttacactcgacgctgccttcgggcgtgtaaaccagccaaccgttttgatacggttcgatgcgcgtcatcggggattgctcgaaaatctgcgcgccggcttcggcagcggcgctggcaacacccaacgtgtaattgagcggatgaagatgcccggacaagggatcgaactgtgcgccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcgcaatcgatggcatgtttgcggacgcgttcgtccaccagttcgaccgcctgcaaagactgttgccaaaaccattgcgcctgctccaagccgacctgtttttcaatttcccccataccgcaggcgtagtcgctgataacctgcccgccactcctgccggacgcgccgaagccgatacgtgcggcttccaaaacgacggcttcatgtccgtgttccgccagcggcaatgcggtacacaaaccgctcaaaccgccgccgataatgcaggtttcggctttcagacggcattggagtttcggataaacagtatgcggattaaccgaactaaaataataagaaggcagatattcttgaaaatcagggcgaatcattgtgtttgctttatcgggtatattttcggacggaatgatacagactgtcgggccatatcgtccaaacagaaaatcggttga

SEQ ID NO: 39715 - protein, 382 aa, Neisseria gonorrhoeae
MRDKVGGNIALPAPRIFDSNIGKLRKNFKHILADKLGHTRRIVDKFVILTAEKQPAVRAEAVIIQNMAVVAYCHIVADKPFCARAQGFGGNNKGADGNRLAFQRPEYRVQTDISIDGIDHIFTLDAAFGRVNQPTVLIRFDARHRGLLENLRAGFGSGAGNTQRVIERMKMPGQGIELCALVHIAVKLLFQLGFIPKLIMTRTVMPLGVFMPLLQLFPMLRTDGNRGITALPIAIDGMFADAFVHQFDRLQRLLPKPLRLLQADLFFNFPHTAGVVADNLPATPAGRAEADTCGFQNDGFMSVFRQRQCGTQTAQTAADNAGFGFQTALEFRINSMRINRTKIIRRQIFLKIRANHCVCFIGYIFGRNDTDCRAISSKQKIG

SEQ ID NO: 39716 - DNA, 1149 bp, Neisseria meningitidis
  misc_feature (821)..(821): n is a, c, g, or t
atgcgggacaaggttggcggtaatgtcgcactccccgccccacgaatattcgattttgacatcggcaagctgcggaaaaactttaagcatatcttggcggacaagctcggtcatacgctcaggattgtcgataaactcgttatccttaccgccgaaaagcagtctgccgtccgcgctgaggcggtaataatccaaaatatggcggttgtcgcatactgccatattgttacggataagcccttttgcgcgcgcccccaagggttcggtcgcaataataaaggtgctgacagcaatcgccttgcgttccaaaggccggaatatcgggttcaaacctgcataagtattgacagcatagaccacatttttgcactcgacgctgccttcgggcgtgtaaaccagccaaccgttttgatgcggttcgatgcacgtcatcggggattgctcgaaaatctgcgcaccggcttcggcagcggcacgagcgatgcccaaagtgtaagtgagcggatgcaggtgtccggataaggggtcgaattgtgccccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcacaatcgacggcatgtttgcggacgcgttcgtccaccagttcgaccgcctgcaaagactgttgccaaaaccattgcgcctgctccaagccgacctgtttttcaatttcccccataccgcagncgtaatcgctgataacctgcccgccactccgtcccgacgcgccgaaaccgatacgcgcggcttccaacacaaccgtttcatgtccctgctccgccaagggcaatgcagtgcacaaaccacccaatccgccgccgatgatacaggtatcggttttcagacggcattgaagtttcggataaacagtatgaggattaaccgaactgaaataataagaaggcagatattcttgaaaatcagggcgaatcattgtgtttgctttatcaggtgtattttcggacggaatgatacaggctgtcgggccatatcgtccawacagaaaatcggttga

SEQ ID NO: 39717 - protein, 382 aa, Neisseria meningitidis
  misc_feature (174)..(174): Xaa can be any naturally occurring amino acid
  misc_feature (274)..(274): Xaa can be any naturally occurring amino acid
  misc_feature (378)..(378): Xaa can be any naturally occurring amino acid
MRDKVGGNVALPAPRIFDFDIGKLRKNFKHILADKLGHTLRIVDKLVILTAEKQSAVRAEAVIIQNMAVVAYCHIVTDKPFCARPQGFGRNNKGADSNRLAFQRPEYRVQTCISIDSIDHIFALDAAFGRVNQPTVLMRFDARHRGLLENLRTGFGSGTSDAQSVSERMQVSGXGVELCPLVHIAVKLLFQLGFIPKLIMTRTVMPLGVFMPLLQLFPMLRTDGNRGITALPITIDGMFADAFVHQFDRLQRLLPKPLRLLQADLFFNFPHTAXVIADNLPATPSRRAETDTRGFQHNRFMSLLRQGQCSAQTTQSAADDTGIGFQTALKFRINSMRINRTEIIRRQIFLKIRANHCVCFIRCIFGRNDTGCRAISSXQKIG

SEQ ID NO: 39718 - DNA, 1149 bp, Neisseria meningitidis
atgcgggacaaggttggcggtaatgtcgcactccccgccccacgaatattcgattttgacatcggcaagctgcggaaaaactttaagcatatcttggcggacaagctcggtcatacgcgcgggattgtcgataaactcgttatccttaccgccgaaaagcagtctgccgtccgcgctgaggcggtaataatccaaaatatgacggttgtcgcatactgccatattgttgcggataagcccttttgcacgcgcgcccaagggttctgtggcaataataaaggtgctgacagcaatcgccttgcgctccaaaggcttgaatatcggattcaaaccggcataagtattgacggcgtacaccagatttttgcattcgacgctgccttcgggggtgtaaaccagccaaccgttttgataaggttcaatgcgtatcatgggagaatgctcaaaaatcttcgtaccagcttcggcagcggcgcgggcgatgcccaacgtgtaattgagcggatggagatgcccggacaagggatcgaactgtgcgccttggtacatatcgctgtcaagctgctgcttcagttcagtgttatcccagagttgataatgagttgcaccgtaatatttttgggcgtgctcatgccattgttgcaattcttcccaatgctgcgaacggatggcaaccgtggcataaccgcgctgccaatcgcaatcaatggcatgtttgcggacgcgttcgtccaccagttcgaccgcctgcaaagactgttgccaaaaccattgcgcttgctccaaaccgacctgtttttcaatttcctccataccgcaggcgtaatcgctgataacctgcccgccactccgtcccgacgcgccgaaaccgatacgcgcggcttccaacacaaccgtttcatgtccctgctccgccaagggcaatgcagtgcacaaaccactcaatccgccgccgatgatacaggtatcggttttcagacggcattgaagtttcggataaacagtatgaggattaaccgaactgaaataataagaaggcagatattcttgaaaatcagggcgaatcattgtgtttgctttatcgggtatattttcggacggaatgatacaggctgtcgagccatatcgtccaaacagaaaatcggttga

SEQ ID NO: 39719 - protein, 382 aa, Neisseria meningitidis
MRDKVGGNVALPAPRIFDFDIGKLRKNFKHILADKLGHTRGIVDKLVILTAEKQSAVRAEAVIIQNMTVVAYCHIVADKPFCTRAQGFCGNNKGADSNRLALQRLEYRIQTGISIDGVHQIFAFDAAFGGVNQPTVLIRFNAYHGRMLKNLRTSFGSGAGDAQRVIERMEMPGQGIELCALVHIAVKLLLQFSVIPELIMSCTVIFLGVLMPLLQFFPMLRTDGNRGITALPIAINGMFADAFVHQFDRLQRLLPKPLRLLQTDLFFNFLHTAGVIADNLPATPSRRAETDTRGFQHNRFMSLLRQGQCSAQTTQSAADDTGIGFQTALKFRINSMRINRTEIIRRQIFLKIRANHCVCFIGYIFGRNDTGCRAISSKQKIG

SEQ ID NO: 39720 - DNA, 1497 bp, Neisseria gonorrhoeae
atgaatttgcctattcaaaaattcatgatgctgttggcagcggcaatatcgatgctgcatatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatacatcccgcagacggatatgacgggcctcaaggcggcggttatccggaaccacaaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaatttaagtccggaagcacaacttgccgccgcgagcctattacaggacagtgcctttgcggtaaaagacggcatcaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctataaaaaacctgctgcccgccatatgcagactgtagatggggagatggcaggggggaatagaccgcctaaatctataacgtcggaaggaaaagctaatgctgcaacctatcctaagttggttaatcagctaaatgagcaaaacttaaataacattgcggctcaagatccaagattgagtctagctattcatgagggtaaaaaaaattttccaataggaactgcaacttatgaagaggcagatagactaggtaaaatttgggttggtgagggtgcaagacaaactagtggaggcggatggttaagtagagatggcactcgacaatatcggccaccaacagaaaaaaaatcacaatttgcaactacaggtattcaagcaaattttgaaacttatactattgattcaaatgaaaaaagaaataaaattaaaaatggacatttaaatattaggtaa

SEQ ID NO: 39721 - protein, 498 aa, Neisseria gonorrhoeae
MNLPIQKFMMLLAAAISMLHIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 39722 - DNA, 1452 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatga

SEQ ID NO: 39723 - protein, 483 aa, Neisseria meningitidis
MNLPIQKFMMLFAAAISLLQIPISHANGLDARLRDDMQAKHYEPGGKYHLFGNARGSVKKRVYAVQTFDATAVSPVLPITHERTGFEGVIGYETHFSGHGHEVHSPFDHHDSKSTSDFSGGVDGGFTVYQLHRTGSEIHPEDGYDGPQGSDYPPPGGARDIYSYYVKGTSTKTKTNIVPQAPFSDRWLKENAGAASGFFSRADEAGKLIWESDPNKNWWANRMDDVRGIVQGAVNPFLMGFQGVGIGAITDSAVSPVTDTAAQQTLQGINDLGKLSPEAQLAAASLLQDSAFAVKDGINSAKQWADAHPNITATAQTALSAAEAAGTVWRGKKVELNPTKWDWVKNTGYKKPAARHMQTLDGEMAGGNKPIKSLPNSAAEKRKQNFEKFNSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 39724 - DNA, 1155 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaatcgggtttacgccgtccaaacatttgatgcaactgcggtcggccccatactgcctattacacacgaacggacaggatttgaaggcattatcggttatgaaacccatttttcaggacatggacatgaagtacacagtccgttcgataatcatgattcaaaaagcacttctgatttcagcggcggcgtagacggtggttttaccgtttaccaacttcatcggacagggtcggaaatccatccggaggatggatatgacgggccgcaaggcagcgattatccgccccccggaggagcaagggatatatacagctactatgtcaaaggaacttcaacaaaaacaaagagtaatattgttccccgagccccattttcagaccgctggctaaaagaaaatgccggtgccgcctctggttttttcagccgtgctgatgaagcaggaaaactgatatgggaaagcgaccccaataaaaattggtgggctaaccgtatggatgatattcgcggcatcgtccaaggtgcggttaatccttttttaatgggttttcaaggagtagggattggggcaattacagacagtgcagtaagcccggtcacagatacagccgcgcagcagactctacaaggtattaatcatttaggaaatttaagtcccgaagcacaacttgcggctgcaaccgcattacaagacagtgcttttgcggtaaaagacggtatcaattccgccagacaatgggctgatgcccatccgaatataactgcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaa

SEQ ID NO: 39725 - protein, 385 aa, Neisseria meningitidis
MNLPIQKFMMLFAAAISLLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYSYYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGINHLGNLSPEAQLAAATALQDSAFAVKDGINSARQWADAHPNITATAQTALAVAEAATTVWGGKKVELNPTKWDWVKNTGYKTPAVRTMHTLDGEMAGGNRPPKSITSNSKADASTQ

SEQ ID NO: 39726 - DNA, 768 bp, Neisseria gonorrhoeae
atgttccaccataaaggtattgcccgaaaccggcggatggaggttttgtttttctgccgccgccctgatcgcttcgtgattcgccaaacgcgcctgttgcagcctcatttgcgcataatcctgctccaaggcgatttcctgttttttcgccttgtccaaagctgtgaagttgagcctgtactggttttgctgcatcacaacggaaaaagcggaaacgcacaccgcaagcagcagaaagaaattcgatttgttcattgccgttcagacgtttttctctgttattattccggtatcggaccggcagtccgctccgccacacgcaaaactgcgctcctcgccctcgggttggcggcaatttccgcttcacccggctttaatgccctgcccacgattttcaggggcggatcgggcaaatccgcttctctgaccgccgcccagctcggcaggggctcgtgttgcgaatattttttgacaaactgcttcacaatgcggtcttccaacgaatggaaagcaatgaccgccaaacgcccgccctctttcagacggcacatgacctgcggcaataccgcccctacttcttcaagctcgcggttaataaagatgcggattgcctggaaggtgcgcgtcgcaggatcctgcccccgctcgcgagtacggacgttttgtgccacgatctgcgccagcttgcgggttgtatcgattggactttccgcccgttgcgcgacaatggcgcgcacaatctggcggctaaaccgctcttcaccataa

SEQ ID NO: 39727 - protein, 255 aa, Neisseria gonorrhoeae
MFHHKGIARNRRMEVLFFCRRPDRFVIRQTRLLQPHLRIILLQGDFLFFRLVQSCEVEPVLVLLHHNGKSGNAHRKQQKEIRFVHCRSDVFLCYYSGIGPAVRSATRKTALLALGLAAISASPGFNALPTIFRGGSGKSASLTAAQLGRGSCCEYFLTNCFTMRSSNEWKAMTAKRPPSFRRHMTCGNTAPTSSSSRLIKMRIAWKVRVAGSCPRSRVRTFCATICASLRVVSIGLSARCATMARTIWRLNRSSP

SEQ ID NO: 39728 - DNA, 768 bp, Neisseria meningitidis
atgctccaccataaaggtmykgcccgaaaccggckgatggaggttttgtttttctgccgccgccctgatcgcttcgtggttcgccaaacgcgcctgttgcagcctcatttgcgcataatcctgctccaaggcgatttcctgttttttcgccttatccaaagctgtgaaattgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccacgattttcaggggcagctcgggcaaatccgcttccctgaccgccgcccagcgcggcaggggcgcgtgttgcgaatattttttgacaaactgcttcacaatgcgatcttccaacgaatggaaagcaatgaccgccaaacgtccgccctctttcagacgacacatgacctgcggcaatactgcccctacttcttcaagctcgcggttaataaagatgcggaccgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatccggcggctaaaccgctcttcaccataa

SEQ ID NO: 39729 - protein, 255 aa, Neisseria meningitidis
  misc_feature (7)..(7): Xaa can be any naturally occurring amino acid
  misc_feature (12)..(12): Xaa can be any naturally occurring amino acid
MLHHKGXARNRXMEVLFFCRRPDRFVVRQTRLLQPHLRIILLQGDFLFFRLIQSCEIEPVLVLLHHNGKSGNAHRKQQKEIQFVHCHSDVFLCDCSGIGPAVRSATRKTALLALGLAAISASPGFNALPTIFRGSSGKSASLTAAQRGRGACCEYFLTNCFTMRSSNEWKAMTAKRPPSFRRHMTCGNTAPTSSSSRLIKMRTAWKVRVAGSCPRSRVRTFCATICASLRVVSIGLSARCATMARAIRRLNRSSP

SEQ ID NO: 39730 - DNA, 768 bp, Neisseria meningitidis
atgctccaccataaaggtattgcccgaaaccggcggatggaggttttgtttttctgccgccgccctgatcgcttcgtggttcgccaaacgcgcctgttgcagcctcatttgcgcataatcctgctccaaggcgatttcctgttttttcgccttatccaaagctgtgaagttgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccgcgattttcaggggcggctcgggcaaatccgcttccctgaccgccgcccagcgcggcaggggcgcgtgttgcgaatattttttgacaaactgcttcacaatgcggtcttccaacgaatggaaagcaatgaccgccaaacgtccgccctctttcagacgacacatgacctgcggcaatactgcccctacttcttcaagctcgcggttaataaagatgcggattgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatctggcggctaaaccgctcttcaccataa

SEQ ID NO: 39731 - protein, 255 aa, Neisseria meningitidis
MLHHKGIARNRRMEVLFFCRRPDRFVVRQTRLLQPHLRIILLQGDFLFFRLIQSCEVEPVLVLLHHNGKSGNAHRKQQKEIQFVHCHSDVFLCDCSGIGPAVRSATRKTALLALGLAAISASPGFNALPAIFRGGSGKSASLTAAQRGRGACCEYFLTNCFTMRSSNEWKAMTAKRPPSFRRHMTCGNTAPTSSSSRLIKMRIAWKVRVAGSCPRSRVRTFCATICASLRVVSIGLSARCATMARAIWRLNRSSP

SEQ ID NO: 39732 - DNA, 663 bp, Neisseria gonorrhoeae
atgatagaagtcatacatttcttcggcgccgaaacgcgcagacagtttgcttgtgccgacgttggacgatttctgcataatgccgcgcacatccaaagaggggtaaacatgggtatcatcgcgcacgggagacggtccgattttataaggctgcgtattcagccgttcgttcaaatcggttttgcccgcatccaatgccttcgcaatcacgaacggtttgattgccgaaccaggttcgatcatatcggttacggcacggttgcgccgctgttcgctgtctgcccggccgggtctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgttttgcggtgctttattgcgcggggagtccaagctgtccacaatattgccctgccggtcccgcaaaacaacttccgcgccgtcttcgccatacaggctgtcttcaagcgaaagttccaaaccttcctgacctttgccgtcaatatcggtaaatccgatgacgtgtgcaaacaggttgcccatcgggtaatggcgttttaa

SEQ ID NO: 39733 - protein, 220 aa, Neisseria gonorrhoeae
MIEVIHFFGAETRRQFACADVGRFLHNAAHIQRGVNMGIIAHGRRSDFIRLRIQPFVQIGFARIQCLRNHERFDCRTRFDHIGYGTVAPLFAVCPAGSVGIVGGRIGQGEDFPRAGIQNHHRSGFCLMVFDRLVQLFIGQGLNPLIEGKDDVFAVLRCFIARGVQAVHNIALPVPQNNFRAVFAIQAVFKRKFQTFLTFAVNIGKSDDVCKQVAHRVMAF

SEQ ID NO: 39734 - DNA, 660 bp, Neisseria meningitidis
atgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaraccaccaccgttccggcttttgcctgatggtattcgaccgccttgttcaactcttcataggccaaggtctgaatcctctgatcgagggaaaggatgatgtctttgccgtttttcggggctttaktgcgcggggagtccaagctgtccacaatattgccctgccggtcccgcaaaacgacttccgcgccgtcttcgccatgcaagctgtcttcaagcgaaagttccaaaccttcctgacctttgccgtcaatatcggtaaatccgatgacgtgtgcaaacaggttgcccatcgggtaatggcgttttaa

SEQ ID NO: 39735 - protein, 219 aa, Neisseria meningitidis
  misc_feature (118)..(118): Xaa can be any naturally occurring amino acid
  misc_feature (159)..(159): Xaa can be any naturally occurring amino acid
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQXHHRSGFCLMVFDRLVQLFIGQGLNPLIEGKDDVFAVFRGFXARGVQAVHNIALPVPQNDFRAVFAMQAVFKRKFQTFLTFAVNIGKSDDVCKQVAHRVMAF

SEQ ID NO: 39736 - DNA, 660 bp, Neisseria meningitidis
atgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgtttttcggggctttattgcgcggggagtccaagctgtccacaatattgccctgccggtcccgcaaaacgacttccgcgccgtcttcgccatgcaggctgtcttcaagcgaaagttccaaaccttcctgacctttgccgtcaatatcggtaaatccgatgacgtgtgcaaacaggttgcccatcgggtaatggcgttttaa

SEQ ID NO: 39737 - protein, 219 aa, Neisseria meningitidis
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQNHHRSGFCLMVFDRLVQLFIGQGLNPLIEGKDDVFAVFRGFIARGVQAVHNIALPVPQNDFRAVFAMQAVFKRKFQTFLTFAVNIGKSDDVCKQVAHRVMAF

SEQ ID NO: 39738 - DNA, 660 bp, Neisseria gonorrhoeae; identical to SEQ ID NO: 39734

SEQ ID NO: 39739 - protein, 267 aa, Neisseria gonorrhoeae
MPTRPTRAANPPTPTTWLQTAYCPRPPYRPPSVQTHTPHEPASSTCAAKSANRRENSHNAQPTYLLHPSNKMPSETEQTLFRRHQIPPSCRQSVVVMTVRTVDMTVCDFLIGCIAHAFNRSFKADFHACQRMVAVHHRLAVGNIGYTIDDNIAGFRIVRFKHHTDLDFNRERARIFNTDQLRIMLTERIVGRKRHFDRIAGILTVQRLFHQRENAVVTAVQIRNRFFGFIQKLIVGIIHLIMQRNHGIFCNSHICPFRNSRLITGAF

SEQ ID NO: 39740 - DNA, 534 bp, Neisseria meningitidis
cggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaa

SEQ ID NO: 39741 - protein, 177 aa, Neisseria meningitidis
RQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 39742 - DNA, 804 bp, Neisseria meningitidis
atgccaacacgtccaactcgcgccgcaaagcatccaaccccgccaacctggcttcagacggcatactgccctcgtccgccatatcgtccgccgtccgtgcaaacgcatacaccgcatgaaccggcttcctcaacctgcgcggcaaaatcagcgaaccgacgggaaaattttcataatgcccaaccgacataccttctccatccatcaaacaaaatgccgtctgaaatggaacaaacccttttcagacggcatcagatacctccaagctgccggcaatcagtggtggtgatgaccgtgcggaccgtggacatgaccgtgtgcgatttcctcatcggatgcatcgcgcacactttcaaccgtagccttaaagcggattttcatgcctgccaaaggatggttgccgtccaccaccgccttaccgtcggcaacatcggttacacgatagacgacaacatcgccggtttcaggatcgtcggcttcaaacatcatgccgacttcgacttcaacagggaacacgcccgcatcttcaatacggaccaactccggatcctgctcgccgaacgcatcgtcgggcgaaagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaattcttcacgatagccatatttgtcctttcaggaacagcagattaattacaggcgcattctaa

SEQ ID NO: 39743 - protein, 267 aa, Neisseria gonorrhoeae
MPTRPTRAAKHPTPPTWLQTAYCPRPPYRPPSVQTHTPHEPASSTCAAKSANRRENFHNAQPTYLLHPSNKMPSEMEQTLFRRHQIPPSCRQSVVVMTVRTVDMTVCDFLIGCIAHTFNRSLKADFHACQRMVAVHHRLTVGNIGYTIDDNIAGFRIVGFKHHADFDFNREHARIFNTDQLRILLAERIVGRKRHIDRIAGILTVQRLFHQRENAVVTAVQIRNRFFGFVQKLIVGIIHLIMQRNHGILHDSHICPFRNSRLITGAF

SEQ ID NO: 39744 - DNA, 660 bp, Neisseria gonorrhoeae; identical to SEQ ID NO: 39734

SEQ ID NO: 39745 - protein, 267 aa, Neisseria gonorrhoeae; identical to SEQ ID NO: 39739

SEQ ID NO: 39746 - DNA, 804 bp, Neisseria meningitidis
atgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaa

SEQ ID NO: 39747 - protein, 267 aa, Neisseria meningitidis
MPTRPTRAANPPTPPTWLQTAYCPRPPYRPPSVQTRTPREPASSTCAAKSANRRENSHNAQPTYLLHPSNKMPSETEQTLFRRHQIPPSCRQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 39748 - DNA, 804 bp, Neisseria meningitidis; identical to SEQ ID NO: 39742

SEQ ID NO: 39749 - protein, 267 aa, Neisseria meningitidis; identical to SEQ ID NO: 39743

SEQ ID NO: 39750 - DNA, 870 bp, Neisseria gonorrhoeae
atgatcggcgaacttgttgttttgttcgtgatcgagcacttcaagcaacgcgctggcgggatcgccccgaaagtcgctgcccaatttgtcgatttcgtcgagcaggaacaacgggtttcttacgcctgcttttgccatattctgcaaaatcttgccgggcatagagccgatataggtacggcggtgcccgcggatttcgctttcgtcgcgcacgccgcccaaggccatacggacatatttccgccccgttgctttggcgatggattcgcccaaagaggttttgcccacgcccggagggccgaccaaacacagaatcggacctttgagcttgtccatacgtttttggacggcgaggtattccaaaatccgttctttgactttttccaggccgtagtggtcggcatccagcaccagtccggctttggcgatgtctttgctgacgcgggattttttcttccacggcagtccgagcagggtgtcgatgtagttgcgtacgacggtggattcggcagacatcggcggcatcattttgagttttttcagttcggacaggcatttttcttccgcttctttggtcatacccgcctttttgatgcctgcctccaaggcatccagttcgccgttttcgtcttcttcgcccaattctttgtgtatcgctttaatctgttcgttcagataatattcgcgttgggatttttccatttggcgtttgacgcgtccgcgtatgcgtttttcggcctgcataatgtcgagttcggattccagctttgccagcaggaattccatccgtttgccgatttcgggaatctccaaaatctgttggcgttgcgccagtttcaactgcaaatgcgctgcgaccgtatcggttag

SEQ ID NO: 39751 - protein, 289 aa, Neisseria gonorrhoeae
MIGELVVLFVIEHFKQRAGGIAPKVAAQFVDFVEQEQRVSYACFCHILQNLAGHRADIGTAVPADFAFVAHAAQGHTDIFPPRCFGDGFAQRGFAHARRADQTQNRTFELVHTFLDGEVFQNPFFDFFQAVVVGIQHQSGFGDVFADAGFFLPRQSEQGVDVVAYDGGFGRHRRHHFEFFQFGQAFFFRFFGHTRLFDACLQGIQFAVFVFFAQFFVYRFNLFVQIIFALGFFHLAFDASAYAFFGLHNVEFGFQLCQQEFHPFADFGNLQNLLALRQFQLQMRCDRIG

SEQ ID NO: 39752 - DNA, 870 bp, Neisseria meningitidis
atgatcggcaaacttgttgttttgttcgggatcgagcacttcgagcaacgcgctggcgggatcgcctcggaagtcgttacccaatttgtcgatttcgtcgagcaggaacaaggggtttttcacgccggcttttgccatattctgcaaaatcttaccgggcatagagccgatataggtgcggcggtgtcccctgatttcgctttcgtcgcgcacgccgcccaaagccatgcggacatatttccgccccgttgctttggcgatggattcgcccaaagaggttttgcccacgcccggagggccgaccaggcacagaatcgggcctttgagtttgtccatacgtttttggacggcgaggtattccaaaatccgttctttgactttttccaggccgtagtggtcggcatccagcaccagtccggctttggcgatgtctttgctgacgcgggattttttcttccacggcagctcgagcaaagtgtcgatgtagttgcgtacgacggtggattccgcagacatcggtggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttag

SEQ ID NO: 39753 - protein, 289 aa, Neisseria meningitidis
MIGKLVVLFGIEHFEQRAGGIASEVVTQFVDFVEQEQGVFHAGFCHILQNLTGHRADIGAAVSPDFAFVAHAAQSHADIFPPRCFGDGFAQRGFAHARRADQAQNRAFEFVHTFLDGEVFQNPFFDFFQAVVVGIQHQSGFGDVFADAGFFLPRQLEQSVDVVAYDGGFRRHRWHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 39754 - DNA, 870 bp, Neisseria meningitidis
  misc_feature (80)..(80): n is a, c, g, or t
atgatcggcgaacttgttgttttgctcgggatcaagcacttcgagcaacgcgctggcgggatcgccccggaagtcgctanccaatttgtcgatttcgtcgagcaggaacaatgggttttttacgccggcttttgccatattctgcaaaatcttaccgggcatggagccgatataggtgcggcggtgtccccggatttcgctttcgtcgcgcacgccgcccaaagccatgcggacatatttccgccccgttgctttggcgatggattcgcccaaagaggttttgcccacgcctggagggccgaccaggcacagaatcgggcctttgagtttgtccatacgtttttggacggcgaggtattccaaaatccgttctttgactttttccaggccgtagtggtcggtatccagcaccaatccggctttggcgatgtctttgctgacgcgggattttttcttccacggcagttcgagcagggtgtcgatgtagttgcgtacgacggtggattcggcagacatcggcggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttag

SEQ ID NO: 39755 - protein, 289 aa, Neisseria meningitidis
  misc_feature (27)..(27): Xaa can be any naturally occurring amino acid
MIGELVVLLGIKHFEQRAGGIAPEVAXQFVDFVEQEQWVFYAGFCHILQNLTGHGADIGAAVSPDFAFVAHAAQSHADIFPPRCFGDGFAQRGFAHAWRADQAQNRAFEFVHTFLDGEVFQNPFFDFFQAVVVGIQHQSGFGDVFADAGFFLPRQFEQGVDVVAYDGGFGRHRRHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 39756 - DNA, 333 bp, Neisseria gonorrhoeae
atggtaatcgtctggttgcccgagttaccgccgatgccggcgacgatgggcatcagcgcggcgagtgcgacgattttttcgatactgccttcaaacgcgccgatgacgcggctggcgaggaaggcggtgcagaggttgacggcgagccacatccagcggtttttgacggaatccaagacgggggcgaacaggtcttcctcttcctgcaaacctgccatgttcaacatatccgcttcggattcttcgcggatcacgtccaccatctcgtcgatggtaatcctgccgatgagctttttgttttcatcaacgacgggcgcggtaaccaagtcgtag

SEQ ID NO: 39757 - protein, 110 aa, Neisseria gonorrhoeae
MVIVWLPELPPMPATMGISAASATIFSILPSNAPMTRLARKAVQRLTASHIQRFLTESKTGANRSSSSCKPAMFNISASDSSRITSTISSMVILPMSFLFSSTTGAVTKS

SEQ ID NO: 39758 - DNA, 333 bp, Neisseria meningitidis
atggtaatcgtctggttgcccgagttaccgcctatgccggcgacgatgggcatcagcgcggygagtgcgacgattttttcgatgctgccttcaaacgcgccgataacacggytggcgaggaaggcggtgcagaggttgacggcgagccacatccagyggtttttcaccgaatcccacacgggggcgaayaggtcttcctcttcctgcaaacccgccatattcagcatatccgcttccgattcttcgcggatcacgtccaccatctcgtcgatggtaatcctgccgatgagctttttgttttcatcgacgacgggcgcggtaaccaagtcgtag

SEQ ID NO: 39759 - protein, 110 aa, Neisseria meningitidis
  misc_feature (21)..(21): Xaa can be any naturally occurring amino acid
  misc_feature (53)..(53): Xaa can be any naturally occurring amino acid
MVIVWLPELPPMPATMGISAXSATIFSMLPSNAPITRLARKAVQRLTASHIQXFFTESHTGANRSSSSCKPAIFSISASDSSRITSTISSMVILPMSFLFSSTTGAVTKS

SEQ ID NO: 39760 - DNA, 333 bp, Neisseria meningitidis
atggtaatcgtctggttgcccgagttaccgcctatgccggcgacgatgggcatcagcgcggcgagtgcgacgattttttcgatgctgccttcaaacgcgccgataacacggctggcgaggaaggcggtgcagaggttgacggcgagccacatccagcggtttttgacggaatccaagacgggggcgaataagtcttcctcttcttgcaaacccgccatattcaacatatccgcttcggattcttcgcggatcacgtccaccatttcgtcaacggtcaccctgccgatgagctttttgttttcatcgacgacgggcgcggtaaccaagtcatag

SEQ ID NO: 39761 - protein, 110 aa, Neisseria meningitidis
MVIVWLPELPPMPATMGISAASATIFSMLPSNAPITRLARKAVQRLTASHIQRFLTESKTGANKSSSSCKPAIFNISASDSSRITSTISSTVTLPMSFLFSSTTGAVTKS

SEQ ID NO: 39762 - DNA, 834 bp, Neisseria gonorrhoeae
atgccgcctgaagcccggccggcgggttcagacggcattgccgctttacttcgatcggtttatacgcaaaacgcgcttcaggaaataaatcagattattccccagacgccttcaggcttccttccgtgccaccgtaaccatagccgggcgcaacacacggtcggacagggtataacccttcttcatcacaccaaccacggtattgggttcctgctcactggccaccgcctgcatcgcctgatggatattcggatcgagcttatcgcccgctttaggattgatttccttgatttgcgtggcatcaaacgccttctgcaactcattcaaagtcatctgcacacccattttcagcgcatcgaaattaccgctctgatccaaaagcgccatttccagataatccttgaccggcaacatttccacggcaaacttctgtccggcgaacttgtgcgtatcggcaatttcctgctggtggcggcggcgcaggttttgctcgtttgccaaagcgcgcagttgttcgtctttcaactgcgcttccagctcggcaatccgcgcctgcaaatcctcataagccggctcggcggcagcctgttcctgtacaccgtccgcatttcctactgtctcgacggtttccaccgcctccacattttcaaccgcttcttcactgttttgctgctgtgtctgttcgctcatatcgtatccctcaaaacaaattggaaatcaaaatccggttattacccgagcaagataaggacattttcaagaaacttcaagcaaaggcaggaaatttcacatccgccgccgaataccctaccgcaaaaaccatataaacggtaa

SEQ ID NO: 39763 - protein, 277 aa, Neisseria gonorrhoeae
MPPEARPAGSDGIAALLRSVYTQNALQEINQIIPQTPSGFLPCHRNHSRAQHTVGQGITLLHHTNHGIGFLLTGHRLHRLMDIRIELIARFRIDFLDLRGIKRLLQLIQSHLHTHFQRIEITALIQKRHFQIILDRQHFHGKLLSGELVRIGNFLLVAAAQVLLVCQSAQLFVFQLRFQLGNPRLQILISRLGGSLFLYTVRISYCLDGFHRLHIFNRFFTVLLLCLFAHIVSLKTNWKSKSGYYPSKIRTFSRNFKQRQEISHPPPNTLPQKPYKR

SEQ ID NO: 39764 - DNA, 831 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgcgccaccgtaaccatagccgggcgcaacacgcggtcggacagcgtataacccttcttcatcacacccaccacggtattcggctcctgttcgcttgccaccgcctgcatcgcctgatggatattcggatcgagcttatcgcccgctttagggttgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttyctgctggtggcggcggcgcaggttttgctcgtttgccaaagcgcgctgctcgtctttcaactgcgtttccagctcggcaatccgcgcctgcaaatcctcataagccggctctgcggcagcctgttcctgcacaccgtccgcatttcctactgtttcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaakcaaaakcagagaatttcaaattcattttcaaatcccctaccgaaaaaataatatagacggtaa

SEQ ID NO: 39765 - protein, 276 aa, Neisseria meningitidis
  misc_feature (256)..(256): Xaa can be any naturally occurring amino acid
  misc_feature (258)..(258): Xaa can be any naturally occurring amino acid
  misc_feature (273)..(273): Xaa can be any naturally occurring amino acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKKXYRR

SEQ ID NO: 39766 - DNA, 834 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgtgccaccgtaaccatagccgggcgcaacacgcggtcggacagcgtataacccttcttcatcacgcccaccacggtattgggttcctgttcgcttgccaccgcctgcatcgcctgatggatattcggatcgagcttatcgcccgctttaggattgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttcctgctggtggcggcggcgcaggttttgctcgtttgccaaagcgcgcagctgctcgtctttcaactgcgcttccagctcggcaatccgcgcctgcaaatcctcataagccggctctgcggcagcctgttcctgcacaccgtccgcatttcctactgtctcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaagcaaaggcagagaatttcaaattcattttcaaatcccctaccgaaaaaataatatagacggtaa

SEQ ID NO: 39767 - protein, 276 aa, Neisseria meningitidis
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKKYRR

SEQ ID NO: 39768 - DNA, 834 bp, Neisseria gonorrhoeae; identical to SEQ ID NO: 39762

SEQ ID NO: 39769 - protein, 277 aa, Neisseria gonorrhoeae; identical to SEQ ID NO: 39763

SEQ ID NO: 39770 - DNA, 819 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgcgccaccgtaaccatagccgggcgcaacacgcggtcggacagcgtataacccttcttcatcacacccaccacggtattcggctcctgttcgcttgccaccgcctgcatcgcctgatggatattcggatcgagcttatcgcccgctttagggttgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttyctgctggtggcggcggcgcaggttttgctcgtttgccaaagcgcgctgctcgtctttcaactgcgtttccagctcggcaatccgcgcctgcaaatcctcataagccggctctgcggcagcctgttcctgcacaccgtccgcatttcctactgtttcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaakcaaaakcagagaatttcaaattcattttcaaatcccctaccgaaaaaataa

SEQ ID NO: 39771 - protein, 272 aa, Neisseria meningitidis
  misc_feature (256)..(256): Xaa can be any naturally occurring amino acid
  misc_feature (258)..(258): Xaa can be any naturally occurring amino acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKK

SEQ ID NO: 39772 - DNA, 822 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgtgccaccgtaaccatagccgggcgcaacacgcggtcggacagcgtataacccttcttcatcacgcccaccacggtattgggttcctgttcgcttgccaccgcctgcatcgcctgatggatattcggatcgagcttatcgcccgctttaggattgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttcctgctggtggcggcggcgcaggttttgctcgtttgccaaagcgcgcagctgctcgtctttcaactgcgcttccagctcggcaatccgcgcctgcaaatcctcataagccggctctgcggcagcctgttcctgcacaccgtccgcatttcctactgtctcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaagcaaaggcagagaatttcaaattcattttcaaatcccctaccgaaaaaataa

SEQ ID NO: 39773 - protein, 273 aa, Neisseria meningitidis
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKK

SEQ ID NO: 39774 - DNA, 510 bp, Neisseria gonorrhoeae
atgtacgggcggaacggtagtactcaagcggccgttgccttcgttttcgaccagacacagcgtgcccgtttcggcaacggcgaagtttacgccgctcaagccgacatcggcagtgctgtaaatatcgcgcagggctttgcgggcgaatccggtcagttggtccacgtcgtctgtaagcggtgtgccgaggttttggtggaacagttcgctgacctgttctttggttttatggattgcgggcatcacgatatgggtcggtttttcgcctgccatttggacgataaactcgcccaagtcgctttccaccgccttaatgccttttgcttcaagataatggttcagctcgatttcttcgctgaccatggatttgcctttgaccatcagcttgccgtttttggctgtgatgatgtcgtggataatttggcaggcttcggcaggggtttccgcccagtgtactttcacgcccaacttagtcaggttttcttccaactgctccagcagcgcgggtaa

SEQ ID NO: 39775 - protein, 169 aa, Neisseria gonorrhoeae
MYGRNGSTQAAVAFVFDQTQRARFGNGEVYAAQADIGSAVNIAQGFAGESGQLVHVVCKRCAEVLVEQFADLFFGFMDCGHHDMGRFFACHLDDKLAQVAFHRLNAFCFKIMVQLDFFADHGFAFDHQLAVFGCDDVVDNLAGFGRGFRPVYFHAQLSQVFFQLLQQRG

SEQ ID NO: 39776 - DNA, 449 bp, Neisseria meningitidis
atgcacgggcggtacggtggtactcaagcgaccgttgcttcgttttccaccagacacagcgtacctgtttcagcaacggcaaagtttacgccactcaaaccgacatcggcagtgctgtaaatatcgcgcagtgctttacgggcgaagccggtcagttggtctacatcgtctgtcagcggcgtaccgaggttttggtggaacagttcgctaacctgttctttggttttgtggatagcaggcatcacgatatgggtcggtttttcgcctgccatttggacgatgaactcgcccaagtcgctttctaccgctttaatgcyttttgcttcaagataatgrttcagctcgatttcctcgctgaccatcgatttgcctttgaccatcagcttgccgtttttggctgtgatgatgtcgtggataatttggcaggcttcggtcggggtttctgcccg

SEQ ID NO: 39777 - protein, 150 aa, Neisseria meningitidis
  misc_feature (113)..(113): Xaa can be any naturally occurring amino acid
MHGRYGGTQATVAFVFHQTQRTCFSNGKVYATQTDIGSAVNIAQCFTGEAGQLVYIVCQRRTEVLVEQFANLFFGFVDSRHHDMGRFFACHLDDELAQVAFYRFNAFCFKIMXQLDFLADHRFAFDHQLAVFGCDDVVDNLAGFGRGFCP

SEQ ID NO: 39778 - DNA, 501 bp, Neisseria meningitidis
atgcacgggcggaacggtggtactcaagcgaccgttgccttcgttttccaccagacacagcgtacctgtttcagcaacggcgaagttcacgccactcaaaccgacatcggcagtgctgtaaatatcgcgcagtgctttacgggcgaagccggtcagttggtctacgtcgtccgttaacggtgtgccgaggttttggtggaacagttcgctaacctgttctttggttttatggattgcgggcatcacgatatgggtcggtttttcacctgccatttggacgatgaactcgcccaagtcgctttccaccgctttaatgccttttgcttcaagataatggttcagctcgatttcctcgctgaccatcgatttgcctttgaccatcagcttgccgtttttggctgtgatgatgtcgtggatgatttcgcaggcttcggccggtgtttccgcccagtgtacttttacgcccaacttggtcaggttttcttccagctgctccagcag

SEQ ID NO: 39779 - protein, 166 aa, Neisseria meningitidis
MHGRNGGTQATVAFVFHQTQRTCFSNGEVHATQTDIGSAVNIAQCFTGEAGQLVYVVRRCAEVLVEQFANLFFGFMDCGHHDMGRFFTCHLDDELAQVAFHRFNAFCFKIMVQLDFLADHRFAFDHQLAVFGCDDVVDDFAGFGRCFRPVYFYAQLGQVFFQLLQQ

SEQ ID NO: 39780 - DNA, 981 bp, Neisseria gonorrhoeae
atgaaacgtaaaatgctaaacgtaccaaagggcggttatgatggtatgaagggttttaccattgttgaatttctggttgcgggcctgctcagtataattgtcctgatagcggtcgtatcgagttactttacatcccggaaattaaatgatgtggcaaacgagcgtcttgccattcaacaggatttgcggaatgcggcaacattaattgtccgcgatgcaagaatggcggggagcttcggttgtttcaatatgtccgagcatactaaagacgatattgttgattcaagtaatcaaactcaatctaaccttgcaaaacccggtgccaaacaagaaaatccccttttttccttaaaaaggagcggcatggataaacaactgattcccgttgctgaatccatagatattaaatatccgggttttatccagcgccttaacgcattggttttccaatacggtatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcagaaacatgtggtcaatgcctatgcggtcggcaggtttggcaataatgaggaaagtttgttccgcttccaattggatgataagggcaagtggggtaatcctcagttgctcgtgaaaaaggttaaacgtatggatgtgcggtatatttatgtttccggttgtcctgaagatgaagatgccggcaaagaggaaaaattcagatatacgaataaattcgacaaatccaaaaatgctgttacgcctgccggggtggaggttttattggatagcggccttaatgccaagattgccgcttcttcagacaatagtatttatgcttaccgtatcaatgcgacaatacgcgggggaaatgtatgcgcaaacagaacactttga

SEQ ID NO: 39781 - protein, 326 aa, Neisseria gonorrhoeae
MKRKMLNVPKGGYDGMKGFTIVEFLVAGLLSIIVLIAVVSSYFTSRKLNDVANERLAIQQDLRNAATLIVRDARMAGSFGCFNMSEHTKDDIVDSSNQTQSNLAKPGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 39782 - DNA, 676 bp, Neisseria meningitidis
atsagacgtaaaatgctaaacgtwsyaraaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaagtttgttccgcttccaattggatgataagggcaagtggggtaatcctcagttgc

SEQ ID NO: 39783 - protein, 225 aa, Neisseria meningitidis
  misc_feature (1)..(1): Xaa can be any naturally occurring amino acid
  misc_feature (9)..(10): Xaa can be any naturally occurring amino acid
XRRKMLNVXXGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEESLFRFQLDDKGKWGNPQL

SEQ ID NO: 39784 - DNA, 999 bp, Neisseria meningitidis
  misc_feature (893)..(893): n is a, c, g, or t
atgagacgtaaaatgctaaacgtaccaaaaggcaattatgatggtatgaagggttttaccattattgaatttttggttgcgggcatgctcagtatgattgtcctgatggcggtcggatcgagttacttcacatcccggaaattaaatgatgcggcaaacgagcgtctttccgcgcaacaggatttgcggaatgcggcaacattgattgtccgcgatgcaagaatggcagggggcttcggttgtttcaatatgtccgagcatactaaaaatgatattattgttgatccaagtaagcaaactcaacatgtccctgtaaaacccggtgccaaacaagaaaatccccttttttctttagagtgggctaatactaataatactaataataatacagctaaattgattcctattgctgaatccacagatattaaatatccgggttttgcccaggctcgtccggcattgattttccaatacggcatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcaaaggcatgtggtcaatgcctatgcggtcggcaggattgccggtgaggaaggtttgttccgcttccaattggatgataagggcaagtggggtaatcctcagttgctcgtgaaaaagattagacatatgaaagtgcggtatatctatgtttccgactgtcctgaagatgacgatgccggcaaagaggaaaaattcaaatatacgggtacattcgacagctccacaaatgctgttacgcccgccggggtggaggttttattgagtancggtactgataccaagattgccgcttcttcagacaatcatatttatgcttaccgtatcgatgcgacaatacgcgggggaaatgtatgcgcaaacagaacactttga

SEQ ID NO: 39785 - protein, 332 aa, Neisseria meningitidis
  misc_feature (298)..(298): Xaa can be any naturally occurring amino acid
MRRKMLNVPKGNYDGMKGFTIIEFLVAGMLSMIVLMAVGSSYFTSRKLNDAANERLSAQQDLRNAATLIVRDARMAGGFGCFNMSEHTKNDIIVDPSKQTQHVPVKPGAKQENPLFSLEWANTNNTNNNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSXGTDTKIAASSDNHIYAYRIDATIRGGNVCANRTL

SEQ ID NO: 39786 - DNA, 666 bp, Neisseria gonorrhoeae
cccggtgccaaacaagaaaatccccttttttccttaaaaaggagcggcatggataaacaactgattcccgttgctgaatccatagatattaaatatccgggttttatccagcgccttaacgcattggttttccaatacggtatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcagaaacatgtggtcaatgcctatgcggtcggcaggtttggcaataatgaggaaagtttgttccgcttccaattggatgataagggcaagtggggtaatcctcagttgctcgtgaaaaaggttaaacgtatggatgtgcggtatatttatgtttccggttgtcctgaagatgaagatgccggcaaagaggaaaaattcagatatacgaataaattcgacaaatccaaaaatgctgttacgcctgccggggtggaggttttattggatagcggccttaatgccaagattgccgcttcttcagacaatagtatttatgcttaccgtatcaatgcgacaatacgcgggggaaatgtatgcgcaaacagaacactttga

SEQ ID NO: 39787 - protein, 221 aa, Neisseria gonorrhoeae
PGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 39788 - DNA, 942 bp, Neisseria meningitidis
atgagacgtaaaatgctaaacgtaccaaaaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaggtttgttccgcttccaattggatgataagggcaagtggggtaatcctcagttgctcgtgaaaaaggttagacatatgaaagtgcggtatatctatgtttccggctgtcctgaagatgacgatgccggcaaagaggaaacattcaaatatacggataaattcgacagcgcccaaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttga

SEQ ID NO: 39789 - protein, 313 aa, Neisseria meningitidis
MRRKMLNVPKGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEEGLFRFQLDDKGKWGNPQLLVKKVRHMKVRYIYVSGCPEDDDAGKEETFKYTDKFDSAQNAVTPAGVEVLLSSGTDTKIAASSDNHIYAYRIDATIRGGNVCANRTL

SEQ ID NO: 39790 - DNA, 618 bp, Neisseria meningitidis
aataatacagctaaattgattcctattgctgaatccacagatattaaatatccgggttttgcccaggctcgtccggcattgattttccaatacggcatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcaaaggcatgtggtcaatgcctatgcggtcggcaggattgccggtgaggaaggtttgttccgcttccaattggatgataagggcaagtggggtaatcctcagttgctcgtgaaaaagattagacatatgaaagtgcggtatatctatgtttccgactgtcctgaagatgacgatgccggcaaagaggaaaaattcaaatatacgggtacattcgacagctccacaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttga

SEQ ID NO: 39791 - protein, 205 aa, Neisseria meningitidis
NNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSSGTDTKIAASSDNHIYAYRIDATIRGGNVCANRTL

SEQ ID NO: 39792 - DNA, 612 bp, Neisseria gonorrhoeae
atgcgcaaacagaacactttgacaggaatcccgacttctgacggacagagggggtccgcactgtttatcgtgctgatggtgatgatagtcgtggcctttttggttgtaactgccgcccagtcctacaataccgaacagaggatcagtgccaacgaatcagacaggaaattggctttgtctttagccgaggcggctttgcgggagggcgaatttcaggttttggatttggaatatgctgcggacagtaaggttacgtttagcgaaaactgtgaaaaaggtctgtgtaccgcagtgaatgtgcggacaaataataatggtagtgaagaggcttttggcaatatcgtggtgcaaggcaagcccgccgttgaggcggtgaaacgttcttgccctgcaaagtctggcaaaaattctaccgacctgtgcattgacaataaagggatggaatataataaaggcgcggcaggcgtcagcaaaatgccgcgctatattatcgaatatttaggcgtgaagaacggacaaaatgtttatcgggttactgccaaggcttggggtaagaatgccaataccgtggtcgtccttcaatcttatgtaggcaataatgatgagcaataa

SEQ ID NO: 39793 - protein, 203 aa, Neisseria gonorrhoeae
MRKQNTLTGIPTSDGQRGSALFIVLMVMIVVAFLVVTAAQSYNTEQRISANESDRKLALSLAEAALREGEFQVLDLEYAADSKVTFSENCEKGLCTAVNVRTNNNGSEEAFGNIVVQGKPAVEAVKRSCPAKSGKNSTDLCIDNKGMEYNKGAAGVSKMPRYIIEYLGVKNGQNVYRVTAKAWGKNANTVVVLQSYVGNNDEQ

SEQ ID NO: 39794 - DNA, 541 bp, Neisseria meningitidis
gggtttgcactgttaatcgtgctgatggtgatratcgtcgtggcttywtggwtgtaactgccgcgcagtcttacaataccgagcagcgkatcagtkccaacgaatcagacaggaaattggctwtgtctttggccgagkcgkctwtgcgggaaggcgaacttcaggttttggatttggaatatgatacggacagtaaggttacatttagcgaaaactgtggaaaaggtctgtstgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggwtggaatataagaaaggcacgagaagcgtcacaaaatgccacgttatattatcgaatatttgggcgtgwagaacggagaaaatgtttatcgggttactgccaaggcttggggtaagaatgccaataccgtggtcgtccttcaatcttatgtaagcaataatgatgagtaa

SEQ ID NO: 39795 - protein, 180 aa, Neisseria meningitidis
  misc_feature (11)..(11): Xaa can be any naturally occurring amino acid
  misc_feature (17)..(18): Xaa can be any naturally occurring amino acid
  misc_feature (33)..(33): Xaa can be any naturally occurring amino acid
  misc_feature (42)..(42): Xaa can be any naturally occurring amino acid
  misc_feature (47)..(49): Xaa can be any naturally occurring amino acid
  misc_feature (78)..(78): Xaa can be any naturally occurring amino acid
  misc_feature (125)..(125): Xaa can be any naturally occurring amino acid
  misc_feature (148)..(148): Xaa can be any naturally occurring amino acid
GFALLIVLMVXIVVAFXXVTAAQSYNTEQRISXNESDRKLAXSLAEXXXREGELQVLDLEYDTDSKVTFSENCGKGLXAAVNVRTNNDNEEAFDNIVVQGKPTVEAVKRSCPANSTDLCIDKKGXEYKKGTRSVTKMPRYIIEYLGVXNGENVYRVTAKAWGKNANTVVVLQSYVSNNDE

SEQ ID NO: 39796 - DNA, 594 bp, Neisseria meningitidis
atgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtaccgcagtgaatgtgcggacaaataatgataatgaagaggcttttgacaatatcgtggtgcaaggcaagcccaccgttgaggcggtgaagcgttcttgcactgcaaaatctacaggcctgtgcattgacaataaagggatggaatataagaaaggcacgcaaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaa

SEQ ID NO: 39797 - protein, 197 aa, Neisseria meningitidis
MRKQNTLTGIPTSDGQRGFALFIVLMVMIVVAFLVVTAAQSYNTEQRISANESDRKLALSLAEAALREGELQVLDLEYDTDSKVTFSENCGKGLCTAVNVRTNNDNEEAFDNIVVQGKPTVEAVKRSCTAKSTGLCIDNKGMEYKKGTQSVSKMPRYIIEYLGVKNGENVYRVTAKAWGKNANTVVVLQSYVSNNDE

SEQ ID NO: 39798 - DNA, 594 bp, Neisseria meningitidis
atgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggatggaatataagaaaggcacgagaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaa

SEQ ID NO: 39799 - protein, 197 aa, Neisseria meningitidis
MRKQNTLTGIPTSDGQRGFALFIVLMVMIVVAFLVVTAAQSYNTEQRISANESDRKLALSLAEAALREGELQVLDLEYDTDSKVTFSENCGKGLCAAVNVRTNNDNEEAFDNIVVQGKPTVEAVKRSCPANSTDLCIDKKGMEYKKGTRSVSKMPRYIIEYLGVKNGENVYRVTAKAWGKNANTVVVLQSYVSNNDE

SEQ ID NO: 39800 - DNA, 612 bp, Neisseria gonorrhoeae
atgaagaataatgattgcttgcgcctgaaaaatccccagtccggtatggcgttgatagaagtcttggtcgctatgctcgttctgaccatcggtattttggcattgctgtccgtacagttgcggacagtcgcttccgtcagggaggcggaaacgcaaaccatcgtcagccaaatcacgcaaaacctgatggaaggaatgttgatgaatccgaccattgatttggacagcaacaagaaaaactatagtctttacatgggaaaacagacactatcagctgtggatggtgagtttatgcttgatgccgagaaaagtaaggcgcagttggcagaggaacaattgaagagatttagtcatgagctgaaaaatgccttgccggatgcggtagctattcattacgccgtctgcaaggattcgtcgggtgacgcgccgacattgtccgacagcggtgctttttcttcaaattgcgacaataaggcaaacggggatactttgattaaagtattgtgggtaaatgattcggcaggggattcggatatttcccgtacgaatcttgaagtgagcggcgacaatatcgtatatacctatcaggcaagggtcggaggtcgtgaatga

SEQ ID NO: 39801 - protein, 203 aa, Neisseria gonorrhoeae
MKNNDCLRLKNPQSGMALIEVLVAMLVLTIGILALLSVQLRTVASVREAETQTIVSQITQNLMEGMLMNPTIDLDSNKKNYSLYMGKQTLSAVDGEFMLDAEKSKAQLAEEQLKRFSHELKNALPDAVAIHYAVCKDSSGDAPTLSDSGAFSSNCDNKANGDTLIKVLWVNDSAGDSDISRTNLEVSGDNIVYTYQARVGGRE

SEQ ID NO: 39802 - DNA, 609 bp, Neisseria meningitidis
  misc_feature (130)..(183): n is a, c, g, or t
atgaagaataatgattgcttccgcctgaaagattcccagtccggtatggcgctgatagaagtcttggttgctatgctcgttctgaccatcggtattttggcactattgtctgtacagttgcggacagtcnnnnnnnnnnnnnnnnnnnnnnnnnnnnnnnnnnnnnnnnnnnnnnnnnnnnnnttgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatga

SEQ ID NO: 39803 - protein, 202 aa, Neisseria meningitidis
  misc_feature (44)..(61): Xaa can be any naturally occurring amino acid
MKNNDCFRLKDSQSGMALIEVLVAMLVLTIGILALLSVQLRTVXXXXXXXXXXXXXXXXXXLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 39804 - DNA, 615 bp, Neisseria meningitidis
atgaagaataatgattgcttccgcctgaaaaacccccagtccggtatggcgctgatagaagtcttggtcgctatgctcgttctgaccatcggtattttggcactattgtctgttcagttgcggacagtcgcttccgtcagggaggcagagacgcaaaccatcgtcagtcaaatcacgcaaaacctgatggaaggaatgttgatgaatccgaccattgattcggacagcaacaagaaaaactataatctttacatgggaaaccatcatgcactatcagttgtggatggcgattttcaggttgatgccataaaaactaagacgcagttggcagaggcacaattgaagagatttagttatgagctgaaaaatgccttgccggatgcggcagccatccattacgccgtctgcaaggattcgtcgggtgttgcgccgacattgtccgccggcagtactttttcttcaaattgcgatggtagtgcaaatggggatactttgattaaagtattgtgggtaaatgattcggcaggggattcggatatcgcccgtacgaatcttgagacgaacggcaacaatatcgtatatacctatcaggcaagggtcggaggtcgggaatga

SEQ ID NO: 39805 - protein, 204 aa, Neisseria meningitidis
MKNNDCFRLKNPQSGMALIEVLVAMLVLTIGILALLSVQLRTVASVREAETQTIVSQITQNLMEGMLMNPTIDSDSNKKNYNLYMGNHHALSVVDGDFQVDAIKTKTQLAEAQLKRFSYELKNALPDAAAIHYAVCKDSSGVAPTLSAGSTFSSNCDGSANGDTLIKVLWVNDSAGDSDIARTNLETNGNNIVYTYQARVGGRE

SEQ ID NO: 39806 - DNA, 609 bp, Neisseria meningitidis
atgaagaataatgattgcttccgcctgaaagattcccagtccggtatggcgctgatagaagtcttggttgctatgctcgttctgaccatcggtattttggcactattgtctgtacagttgcggacagtcgcttccgtcagggaggcggagacacaaaccatcgtcagccaaatcacgcaaaacctgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatga

SEQ ID NO: 39807 - protein, 202 aa, Neisseria meningitidis
MKNNDCFRLKDSQSGMALIEVLVAMLVLTIGILALLSVQLRTVASVREAETQTIVSQITQNLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 39808 - DNA, 342 bp, Neisseria gonorrhoeae
atgacgcacacagcctctccacgtgatgaattcatacgcggcataaaagaaagttcgcccatgctgattgggcttttgccttgggcattgatactcggtatgcagggcgggcaaaaaggtatgggccggctggaaatgctgctgatgacggggatgaactttgccggcggctccgaatttgccacggtcaacctgtgggcggaacctctgccgatactgcttatcgccaccataacctttatgattaattcgcggcatatcctgatggggggcggcgcttgccacgcacatgaaagaaataccgctgaaaaaagccgcgcccgcgctgttttttatgtgtga

SEQ ID NO: 39809 - protein, 113 aa, Neisseria gonorrhoeae
MTHTASPRDEFIRGIKESSPMLIGLLPWALILGMQGGQKGMGRLEMLLMTGMNFAGGSEFATVNLWAEPLPILLIATITFMINSRHILMGGGACHAHERNTAEKSRARAVFYV

SEQ ID NO: 39810 - DNA, 336 bp, Neisseria meningitidis
atgcacaccttccccgcataacgaatttatacgcggcatcaaagaaagttcgcctatgctgattgggctgctgccttgggcattaatactcggtatgcagggcggacaaaaaggcatgagctggctggaaatgttgttgatgaccagtatgaacttcgccggcggctccgagtttgccacggtcaacctgtgggcsgaacctctgccgatactgcttatcgccaccgtaacctttatgattaattctcggcatatcctgatgggggcggcgcttgccccgcacctgaaaggaataccgctgaaaaaagccgtgcccgcactgttttttatgtgtga

SEQ ID NO: 39811 - protein, 112 aa, Neisseria meningitidis
MHTPSPHNEFIRGIKESSPMLIGLLPWALILGMQGGQKGMSWLEMLLMTSMNFAGGSEFATVNLWAEPLPILLIATVTFMINSRHILMGGGACPAPERNTAEKSRARTVFYV

SEQ ID NO: 39812 - DNA, 341 bp, Neisseria meningitidis
atgacacacataagctcgccccgtaacgaatttatacgcggcatcaaagaaagttcgcccatgctgatcgggcttttgccttgggcattaatactcggtatgcagggtggacaaaaaggcatgagctggctggaaatgttgttgatgaccggtatgaacttcgccggcggctccgagtttgccacggtcaacctgtgggcggaacctctgccgatactgcttatcgccaccgtaacctttatgattaattctcggcatatcctgatgggggcggcacttgccccgcacctgaaagaaataccgctgaaaaaagccgtgcccgcactgttttttatgtgtga

SEQ ID NO: 39813 - protein, 113 aa, Neisseria meningitidis
  misc_feature (91)..(91): Xaa can be any naturally occurring amino acid
MTHISSPRNEFIRGIKESSPMLIGLLPWALILGMQGGQKGMSWLEMLLMTGMNFAGGSEFATVNLWAEPLPILLIATVTFMINSRHILMGXGTCPAPERNTAEKSRARTVFYV

SEQ ID NO: 39814 - DNA, 735 bp, Neisseria gonorrhoeae
atgcctgacccaatagggattcttttcgctgccgtcggggttgatttttttgccgttgttttgagggggcgttttcaacgaataggcgcggttggcatgttgataataataatcctgatggcggaggtcggaaccaaaacggtcgtaaccgaggttgacgctcaggttgtggcggattttggcggtatcgaaggattttttgaatgccgcctgcaagagcctgtggctttccccgtaaatcacgcggtcggatttgtagtaggaagacggcttgtcggcactcgggcggcaatatttgtccgaaccgtcggcggaacagtgcgtctgctgaaaatgattgtccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccacctccgcaccgttttcaccgttggtaatcagcccgctgtatttgcggccgcccgcgtatttgccgtagcctcttatcgatccgtattttttattttcatcaaaaaccgccttggtcaggaatgccggaaccgtcatatcgcgcgtgtcgaaagtttgctgcgtgcgttcgagtatgccgccgatgtagtgccgtttgttttcaaaacgaaaacccgggcggaacagccacgaccggctttcgtatga

SEQ ID NO: 39815 - protein, 244 aa, Neisseria gonorrhoeae
MPDPIGILFAAVGVDFFAVVLRGRFQRIGAVGMLIIIILMAEVGTKTVVTEVDAQVVADFGGIEGFFECRLQEPVAFPVNHAVGFVVGRRLVGTRAAIFVRTVGGTVRLLKMIVQTDALPVVREAGIIRPSVFIGIGIDIFQTVAAFGVRLVVKHARTVFRAHLRTVFTVGNQPAVFAAARVFAVASYRSVFFIFIKNRLGQECRNRHIARVESLLRAFEYAADVVPFVFKTKTRAEQPRPAFV

SEQ ID NO: 39816 - DNA, 915 bp, Neisseria meningitidis
atgcgtgctgcggtagtcgtagcgcaagcccgcgccgacatccgcccacctgcccaaacggacattgtcccgaactgccgcgtaatagcttttaccgttgatgctgcgcggcgtgcagtccgtataagtattgttgcccaagcggcagatttgccccgtaacgacatttcccctgcctatggtgacccaataggggctggtttcactgccgttggggctgatttttttgccgttgttttgagggggcgtgttcgacgaataggcgcggttggcatgttgataataataatcctgatggcggagattagagccaaagcggtcaaacccgagattcacgctcaggttgtggcggattttggcggtatcgaaggattttttgaatgccgcctgcaagagcctgtggctttccccgtaaatcacgcgatcggatttgtaataggaaaacggcttgtcggcactcgggcggcaatatttgtccgaaccgtcggcagaacagtgcgtctgctgaaaatgattatccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagtccgccgtatttgtggttgcccgcgtatttgccgttaccgggcaaagaacccgcctgttttttatttgcatcaaaaaccgccttggtcaggaatgccggaaccgtcatatcgcgcgtgtcgaaagtttgttgcgtgtgttcgagtatgccgccgatgtagtgccgcttattctcaaaacgaaaacccgggcggaacagccacgaccggctttcgtatga

SEQ ID NO: 39817 - protein, 304 aa, Neisseria meningitidis
MRAAVVVAQARADIRPPAQTDIVPNCRVIAFTVDAARRAVRISIVAQAADLPRNDISPAYGDPIGAGFTAVGADFFAVVLRGRVRRIGAVGMLIIIILMAEIRAKAVKPEIHAQVVADFGGIEGFFECRLQEPVAFPVNHAIGFVIGKRLVGTRAAIFVRTVGRTVRLLKMIIQTDALPVVREAGIIRPSVFIGIGIDIFQTVAAFGVRLVVKHARTVFRAHQRTVFAVGKQSAVFVVARVFAVTGQRTRLFFICIKNRLGQECRNRHIARVESLLRVFEYAADVVPLILKTKTRAEQPRPAFV

SEQ ID NO: 39818 - DNA, 900 bp, Neisseria meningitidis
atgcgtgctgcggtagtcgtagcgcaaccccgcgccgacatccgcccacctgcccaaacggacattgtcccgaactgccgcgtaatagcttttgccgttgatgctgcgcggcgtgcagtccgtataagtattgttgcccaagcggcagatttgccccgtaaccacatttcccctgcctatgctgacccaatagggttggtccttgccgccgttggggttggcggttttagggggcgttttcgacgaataggcgcggttggcatgttgataataataatcctgatggcggagattagagtcaaagcggtcaaaaccgagattcacgctcaggttgtggcggattttggcggtatcgaaggattttttgaatgccgcctgcaagagcctgtggctttccccgtaaatcacgcggtcggatttgtagtaggaaaacggcttgtcggcactcgggcggcaatatttgtccgaaccgtcggcagaacagtgcgtctgctgaaaatgattgtccaaaccgatgccctgccggtcgtaagagaggcgggcataatccacccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagaccgccgtatttgtggtcgcccgcgtatttgccgttgcctcttatcggtccgtattttctattttcatcaaaaaccgccttggtcaggaatgccggaaccgtcatatcgcgcgtgtcgaaagtttgttgcgtgtgttcgagtatgccgccgatgtagtgccgtttgttttcaaaacgaaaacccgggcggaacagccacgatcggctttcgtatga

SEQ ID NO: 39819 - protein, 299 aa, Neisseria meningitidis
MRAAVVVAQPRADIRPPAQTDIVPNCRVIAFAVDAARRAVRISIVAQAADLPRNHISPAYADPIGLVLAAVGVGGFRGRFRRIGAVGMLIIIILMAEIRVKAVKTEIHAQVVADFGGIEGFFECRLQEPVAFPVNHAVGFVVGKRLVGTRAAIFVRTVGRTVRLLKMIVQTDALPVVREAGIIHPSVFIGIGIDIFQTVAAFGVRLVVKHARTVFRAHQRTVFAVGKQTAVFVVARVFAVASYRSVFSIFIKNRLGQECRNRHIARVESLLRVFEYAADVVPFVFKTKTRAEQPRSAFV

SEQ ID NO: 39820 - DNA, 1194 bp, Neisseria gonorrhoeae
atgatcgacagggaccgtatgttgcgggacacgttggaacgtgtgcgtgcggggtcgttctggttatgggtggtggtggcatcgatgatgtttaccgccggattttcaggcacttatcttctgatggacaatcaggggctgaatttctttttagttttggcgggagtgttgggcatgaatacgctgatgctggcagtatggttggcaacgttgttcctgcgcgtgaaagtgggacggtttttcagcagtccggcgacgtggtttcggggcaaaggccctgtaaatcaggcggtgttgcggctgtatgcggaccagtggcggcaaccttcggtacgatggaaaataggcgcaacggcgcacagcttgtggctctgcacgctgctcggaatgctggtgtcggtattgctgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggtcgtctgaacggcaatattgccgatgcgcgggcttggtcggggctgctggtcggcagtatcgtctgctacggcatcctgccgcgcctcttggcttgggtagtgtgtaaaatccttttgaaaacaagcgaaaacggattggatttggaaaaaacctattatcaggcggtcatccgccgctggcagaacaaaatcaccgatgcggatacgcgtcgggaaaccgtgtccgccgtttcgccgaaaatcgtcttgaacgatgcgccgaaatgggcgctcatgctggagaccgagtggcaggacggccaatggttcgagggcaggctggcgcaggaatggctggataagggcgttgccgccaatcgggaacaggttgccgcgctggagacagagctgaagcagaaaccggcgcaactgcttatcggcgtacgcgcccaaactgtgccggaccggggcgtgctgcggcagattgtgcggctttcggaagcggcgcagggcggcgcggtggtgcagcttttggcggaacaggggctttcagacgacctttcggaaaagctggaacattggcgtaacgcgctgaccgaatgcggcgcggcgtggcttgagcctgacagggtggcgcaggaaggccgtttgaaagaccaataa

SEQ ID NO: 39821 - protein, 397 aa, Neisseria gonorrhoeae
MIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 39822 - DNA, 1194 bp, Neisseria meningitidis
atgattgacaggaaccgtatgctgcgggagacgttggaacgtgtgcgtgcggggtcgttctggttgtgggtggtggcggcgacgtttgcattttttaccggtttttcagtcacttatcttctaatggacaatcagggtctgaatttctttttggttttggcgggcgtgttgggcatgaatacgctgatgctggcagtatggttggcaatgttgttcctgcgtgtgaaagtggggcgttttttcagcagtccggcgacgtggtttcggggcaaagaccctgtaaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggccgtctgaacggcaatattgccgatgcgcgggcttggtcggggctgctggtcggcagtatcgcctgctacggcatcctgccgcgcctgctggcttgggtagtgtgtaaaatccttttgaaaacaagcgaaaacggattggatttggaaaagccctattatcaggcggtcatccgccgctggcagaacaaaatcaccgatgcggatacgcgtcgggaaaccgtgtccgccgtttcaccgaaaatcatcttgaacgatgcgccgaaatgggcggtcatgctggagaccgagtggcaggacggcgaatggttcgagggcaggctggcgcaggaatggctggataagggcgttgccaccaatcgggaacaggttgccgcgctggagacagagctgaagcagaaaccggcgcaactgcttatcggcgtgcgcgcccaaactgtgccggaccgcggcgtgttgcggcagattgtccgactctcggaagcggcgcagggcggcgcggtggtgcagcttttggcggaacaggggctttcagacgacctttcggaaaagctggaacattggcgtaacgcgctggccgaatgcggcgcggcgtggcttgagcctgacagggcggcgcaggaagggcgtttgaaagaccaataa

SEQ ID NO: 39823 - protein, 397 aa, Neisseria meningitidis
MIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 39824 - DNA, 1203 bp, Neisseria meningitidis
atgatcgacaggaaccgtatgctgcgggagacgttggaacgtgtgcgtgcggggtcgttctggttgtgggtggcggcggcgacgtttgcgttttttaccggtttttcagttacttatcttctaatggacaatcagggtctgaatttctttttggttttggcgggcgtgttgggcatgaatacgctgatgctggcagtatggttggcaatgttgttcctgcgcgtgaaagtggggcgttttttcagcagtccggcgacgtggtttcggggcaaagaccctgtcaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgggcgattcgtcttcggtacggctggtggaaatgttggcatggctgcctgcgaaactgggttttcccgtgcctgatgcgcgggcggtcatcgaaggtcgtctgaacggcaatattgccgatgcgcgggcttggtcggggctgctggtcggcagtatcgcctgctacggcatcctgccgcgcctcttggcttgggcggtatgcaaaatccttttgaaaacaagcgaaaacggcttggatttggaaaagccctattatcaggcggtcatccgccgctggcagaacaaaatcaccgatgcggatacgcgtcgggaaaccgtgtccgccgtttcgccgaaaatcgtcttgaacgatgcgccgaaatgggcggtcatgctggagaccgaatggcaggacggcgaatggttcgagggcaggctggcgcaggaatggctggataagggcgttgccgccaatcgggaacaggttgccgcgctggagacagagctgaagcagaaaccggcgcaactgcttatcggcgtgcgcgcccaaactgtgcccgaccgcggcgtgttgcggcagatcgtccgactttcggaagcggcgcagggcggcgcggtggtgcagcttttggcggaacaggggctttcagacgacctttcggaaaagctggaacattggcgtaacgcgctgaccgaatgcggcgcggcgtggctggaacccgacagagcggcgcaggaaggccgtctgaaaaccaacgaccgcacttga

SEQ ID NO: 39825 - protein, 400 aa, Neisseria meningitidis
MIDRNRMLRETLERVRAGSFWLWVAAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILLKTSENGLDLEKPYYQAVIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRAAQEGRLKTNDRT

SEQ ID NO: 39826 - DNA, 627 bp, Neisseria gonorrhoeae
atgtatgcaggcgaacgcttcaatacttacagccatttgagcggtttgattctggcggcggcaggtttgatgctgatgctgctgaaaaccataggacacggggacggataccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgcgatttatatcgtaatgggctggatggtcttggcggtaatgaaatccctgacagcctcactcccgccggcaggactggcttggctggcggcaggcggtatgctgtacagcgtcggcatttactggtttgtaaacgatgaaaaaatccgacacgggcacggaatctggcatctgttcgtattgggcggcagcataacccaatttgtcagcgtgtacggttatgtaatctga

SEQ ID NO: 39827 - protein, 208 aa, Neisseria gonorrhoeae
MYAGERFNTYSHLSGLILAAAGLMLMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 39828 - DNA, 504 bp, Neisseria meningitidis
gtatcggtttacggcatcagccttcttctgctctatttgagttcctggctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctga

SEQ ID NO: 39829 - protein, 167 aa, Neisseria meningitidis
VSVYGISLLLLYLSSWLYHGIAAGKLKSILKKTDHCMIYVLIAGSYTPFALVSLRNGPGWTVFSLSWLLAAAGIAQELTIGRKSEKRLLSIVIYVVMGWMVLAVMKSLTASLPSAGLAWLAAGGMLYSVGIYWFVNDEKIRHGHGIWHLFVLGGSITQFVSVYGYVI

SEQ ID NO: 39830 - DNA, 627 bp, Neisseria meningitidis
atgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccattggacggaaaagcgaaaaacgactgctgtctattgcgatttatatcgtaatgggctggatggtcttggcggtaatgaaatccctgacagcctcactcccgccggcaggactggcttggctggcggcaggcggtatgctgtacagcgtcggcatttactggtttgtaaacgatgaaaaaatccgacacgggcacggaatctggcatctgttcgtattgggcggcagcatcacccaatttgtcagcgtgtacggttacgtaatctga

SEQ ID NO: 39831 - protein, 208 aa, Neisseria meningitidis
MYTGERFNTYSHLSGLILAAAGLALMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 39832 - DNA, 567 bp, Neisseria gonorrhoeae
atggttggacaggaagccttgcggggtcagttcgtcgccgtgttcgctgccgcgttgcgttacgctgtcaaaacctgcgccgatttccacgcctttgacggcgttgatgcccatcatcgcgtaggcgatttcggcatcgaggcggtcgaaaacgggttcgcccaaaccgacggggacgttggcggcttcgatatgcagtttcgcgccgacggaatccaaggatttgcgcacaccgtccatatagtgttccagttcggcgatttggctttggttggcggcaaaaaaaggattttgggaaatgtgttcgctgccttcaaaccggatttttttttcgccgacttgggtaacgtaggcggtgatttccgtgccgaatttttctttcagccattttttggcaacggctccggcggcaacgcgggctgcggtttcgcgggcggaactcctgccgccgccccggtagtcgcgcgtaccgtatttgtgccaataggtatagtcggcgtgtccggggcggaaggcggtggcgatgtcgccgtagtcttcgctgcgctggtcggtgttgcggattag

SEQ ID NO: 39833 - protein, 188 aa, Neisseria gonorrhoeae
MVGQEALRGQFVAVFAAALRYAVKTCADFHAFDGVDAHHRVGDFGIEAVENGFAQTDGDVGGFDMQFRADGIQGFAHTVHIVFQFGDLALVGGKKRILGNVFAAFKPDFFFADLGNVGGDFRAEFFFQPFFGNGSGGNAGCGFAGGTPAAAPVVARTVFVPIGIVGVSGAEGGGDVAVVFAALVGVAD

SEQ ID NO: 39834 - DNA, 567 bp, Neisseria meningitidis
gtggttggacaggaagccttgcggggtcagttcgtcgccgtgttcgctgccgcgttgcgttacgctgtcaaaacctgcgccgatttccacgcctttgacggcgttgatgcccatcatcgcgtaggcgatttcggcatcgaggcggtcaaaaacaggttcgcccaagccgacagggacattggctgcttcgatatgcagcttcgcgccgacggaatccaaggatttgcgcacgctgtccatatagttttccagctcggcaatttggctatggttggcggcaaaaaaaggattttgggaaatgtgttcgcagccttcaaaccggatttctttttcgccgacttgggtaacgtaggcggtgatttccgtgccgaatttttctttcaaccattttttggcaacggctccggcagcaacgcgggcggcggtttcacgggcggagctcctgccgccgccgcggtagtcgcgcgtgccgtatttgtgccaataggtatagtcggcgtggccggggcggaagctggtggcgatgttgccgtagtctttgctgcgctggtcggtattgcggattaa

SEQ ID NO: 39835 - protein, 188 aa, Neisseria meningitidis
VVGQEALRGQFVAVFAAALRYAVKTCADFHAFDGVDAHHRVGDFGIEAVKNRFAQADRDIGCFDMQLRADGIQGFAHAVHIVFQLGNLAMVGGKKRILGNVFAAFKPDFFFADLGNVGGDFRAEFFFQPFFGNGSGSNAGGGFTGGAPAAAAVVARAVFVPIGIVGVAGAEAGGDVAVVFAALVGIAD

SEQ ID NO: 39836 - DNA, 567 bp, Neisseria meningitidis
gtggttggacaggaagccttgcggggtgagttcgtcgccgtgttcgctgccgcgttgcgttacgctgtcaaaacctgcgccgatttccacgcctttgacggcgttgatgcccatcatggcgtaggcgatttcggcatcgaggcggtcgaatacgggttcgcccaagccgacggggacgttggcggcttcaatatgcagcttcgcgccgacggaatccaaggatttgcgcacgctgtccatatagttttccagctcggcaatttggctatggttggcggcaaaaaaaggattttgggaaatgtgttcgcagccttcaaaccggatttctttttcgccgacttgggtaacgtaggcggtgatttccgtgccgaatttttctttcaaccattttttggcaacggctccggcggcaacgcgggcggcggtttcgcgggcggaactcctgccgccgccccggtagtcgcgcgtgccgtatttgtgccaataggtatagtcggcgtggccggggcggaagctggtggcgatgttgccgtagtctttgctgcgctggtcggtattgcggattaa

SEQ ID NO: 39837 - protein, 188 aa, Neisseria meningitidis
VVGQEALRGEFVAVFAAALRYAVKTCADFHAFDGVDAHHGVGDFGIEAVEYGFAQADGDVGGFNMQLRADGIQGFAHAVHIVFQLGNLAMVGGKKRILGNVFAAFKPDFFFADLGNVGGDFRAEFFFQPFFGNGSGGNAGGGFAGGTPAAAPVVARAVFVPIGIVGVAGAEAGGDVAVVFAALVGIAD

SEQ ID NO: 39838 - DNA, 720 bp, Neisseria gonorrhoeae
atgctcgcggtacgcaatcggggttggcacggcgcagtcgtccatttccgcagctgcggcggcgtagcgaacaccgccccggtgttctaccacttgggtgataccgccgaaatcgcctttgctttggacacgctcaccgcgcgttaccgtgaaatatacgccgtcggcgtatcgctgggcggcaacgcgccggcaaaatatttgggcgaacagggcaaaaaggcattgccgcacgcctcggccgccgtatccgcccccgttgatgcagaggcggcaggcagccgcttcgacagcggcatcacgcggctgctctacacgcgctacttcctccgcacactgatacccaaagcacgttcgctccaaggttttcagacggcatttgccgcagggtgcaaaacactgggcgagtttgacgaccgtttcaccgcaccgctgcacggctttgccgaccggcacgactactaccgccaaacttcctgcaaaccgctgctcaaacacgttgccaaaccgctgctcctgctcaatgccgccaacgaccccttcctgccgcccgaagccctgccccgtgcagacgaagcgtccgaagccgttaccctgttccaacctgcacacggcgggcacgccggctttgtcagcagcaccggcggcaggctgcacctgcaatggctgccgcagaccgtcctgtcctattttgacagcttccgcacaaacaggcgttaa

SEQ ID NO: 39839 - protein, 239 aa, Neisseria gonorrhoeae
MLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 39840 - DNA, 719 bp, Neisseria meningitidis
atgcttgcggtacgcgatcggggttggcacggcgtagtcgtccatttccgcagctgcggcggcattgccaacaccgctccggtgttctaccacttggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaa

SEQ ID NO: 39841 - protein, 239 aa, Neisseria meningitidis
  misc_feature (31)..(31): Xaa can be any naturally occurring amino acid
MLAVRDRGWHGVVVHFRSCGGIANTAPVFYXLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 39842 - DNA, 720 bp, Neisseria meningitidis
atgctcgcggtacgcgatcggggttggaacggcgtagtcgtccatttccgcagctgcggcggcgtagcgaacaccgccccggtgttctaccacttgggcgataccgccgaaattgcctttactttggacacgctcgccgcgcgttaccgtgaaatatacgccgtcggcgtatcgctgggcggcaacgcgctggcaaaatatttgggcgaacagggcgaaaacgcgctgccgcaagccgccgccgtcatctccgcacccgtcgatgcagaggcggcaggcaaccgcttcgacagcggcatcacacggctgctctacacgcgctacttcctccgcacactgatacccaaagcacggtcgctccaaggttttcagacggcatttgccgcagggtgcaaaacactgggcgagtttgacgaccgtttcaccgcaccgctgcacggctttgccgatcggcacgactactaccgccaaacttcctgcaaaccgctgctcaaacacgttgccaaaccgctgctcctgctcaatgccgtcaacgaccccttcctgccgcccgaagcgctgccccgcgcagacgaagtgtccgaagccgttaccctgttccagccgacacacggtggtcatgtcggctttgtcggcagcaccggcggcaggctgcacctgcaatggttgccgcagaccgtcctgtcctatttcgacagcttccgcacaaacaggcgttaa

SEQ ID NO: 39843 - protein, 239 aa, Neisseria meningitidis
MLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 39844 - DNA, 960 bp, Neisseria gonorrhoeae
atgattttgacaccgccggacacgccctttttcctccgcaacggcaatgccgacacgattgccgccaaattcctgcaacaccccgcacccgcataccgccgcgagatgcttcccgacagcacgggtaaaaccaaaaccgcctacgacttttcagcaggcggcatttcgcccgatgcgccgctggtcgtgctgtttcacggtttggaaggaagcagccgcagccattacgcggtcgaactgatgctcgcggtacgcaatcggggttggcacggcgcagtcgtccatttccgcagctgcggcggcgtagcgaacaccgccccggtgttctaccacttgggtgataccgccgaaatcgcctttgctttggacacgctcaccgcgcgttaccgtgaaatatacgccgtcggcgtatcgctgggcggcaacgcgccggcaaaatatttgggcgaacagggcaaaaaggcattgccgcacgcctcggccgccgtatccgcccccgttgatgcagaggcggcaggcagccgcttcgacagcggcatcacgcggctgctctacacgcgctacttcctccgcacactgatacccaaagcacgttcgctccaaggttttcagacggcatttgccgcagggtgcaaaacactgggcgagtttgacgaccgtttcaccgcaccgctgcacggctttgccgaccggcacgactactaccgccaaacttcctgcaaaccgctgctcaaacacgttgccaaaccgctgctcctgctcaatgccgccaacgaccccttcctgccgcccgaagccctgccccgtgcagacgaagcgtccgaagccgttaccctgttccaacctgcacacggcgggcacgccggctttgtcagcagcaccggcggcaggctgcacctgcaatggctgccgcagaccgtcctgtcctattttgacagcttccgcacaaacaggcgttaa

SEQ ID NO: 39845 - protein, 319 aa, Neisseria gonorrhoeae
MILTPPDTPFFLRNGNADTIAAKFLQHPAPAYRREMLPDSTGKTKTAYDFSAGGISPDAPLVVLFHGLEGSSRSHYAVELMLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 39846 - DNA, 957 bp, Neisseria meningitidis
atgattttaacaccgccggacacgccctttttcctccgcaacggcaatgccgacacgattgccgccaaattcctgcaacgccccgcgcccgcataccgccgagagctgcttcccgacagcacgggtaaaaccaaagtcgcctacgacttttcagacggcatttcgcccgatgcgccgctggtcgtgctgtttcacggtttggaaggaagcagccgcagccattacgcggtcgaactgatgcttgcggtacgcgatcggggttggcacggcgtagtcgtccatttccgcagctgcggcggcattgccaacaccgctccggtgttctaccacttgggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaa

SEQ ID NO: 39847 - protein, 318 aa, Neisseria meningitidis
MILTPPDTPFFLRNGNADTIAAKFLQRPAPAYRRELLPDSTGKTKVAYDFSDGISPDAPLVVLFHGLEGSSRSHYAVELMLAVRDRGWHGVVVHFRSCGGIANTAPVFYHLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 39848 - DNA, 957 bp, Neisseria meningitidis
atgattttgacaccgccggacacaccctttttcctccgcaacggcaatgccgacacgattgccgccaaattcctgcaacgctccgcacctgcataccgccgcgagctgcttcccgacagcacgggtaaaaccaaaaccgcctacgacttttcagacggcatttcgcccgatgcgccgctggtcgtgctgtttcacggtttggagggcggcagtggcagccattacgcggtcgaactgatgctcgcggtacgcgatcggggttggaacggcgtagtcgtccatttccgcagctgcggcggcgtagcgaacaccgccccggtgttctaccacttgggcgataccgccgaaattgcctttactttggacacgctcgccgcgcgttaccgtgaaatatacgccgtcggcgtatcgctgggcggcaacgcgctggcaaaatatttgggcgaacagggcgaaaacgcgctgccgcaagccgccgccgtcatctccgcacccgtcgatgcagaggcggcaggcaaccgcttcgacagcggcatcacacggctgctctacacgcgctacttcctccgcacactgatacccaaagcacggtcgctccaaggttttcagacggcatttgccgcagggtgcaaaacactgggcgagtttgacgaccgtttcaccgcaccgctgcacggctttgccgatcggcacgactactaccgccaaacttcctgcaaaccgctgctcaaacacgttgccaaaccgctgctcctgctcaatgccgtcaacgaccccttcctgccgcccgaagcgctgccccgcgcagacgaagtgtccgaagccgttaccctgttccagccgacacacggtggtcatgtcggctttgtcggcagcaccggcggcaggctgcacctgcaatggttgccgcagaccgtcctgtcctatttcgacagcttccgcacaaacaggcgttaa

SEQ ID NO: 39849 - protein, 318 aa, Neisseria meningitidis
MILTPPDTPFFLRNGNADTIAAKFLQRSAPAYRRELLPDSTGKTKTAYDFSDGISPDAPLVVLFHGLEGGSGSHYAVELMLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 39850 - DNA, 381 bp, Neisseria gonorrhoeae
atgggcaggcatttcgggcgcagacgttttctgacggctgccgccgttgctgtggccggtgcggcggtttcttttttgccgaatccttttgccgccggcggcgaaaaacgcaacatggataaaaaacgcgatgaaaatgtgtttttctggaaaggtgtcgcgctgggttccggcgcggagctgcgcctgttcggcgtggacgacagacaggcggcggatttggtcaataaggttttggcggaagtggcgcgtttggaaaaaatgttcagcctttaccgtgaagacagcctgatcagccgtctgaaccgcgacggttatctgacttcgcctccggcggattttttggaactgttgagcctggccgcgatattcacgcgctga

SEQ ID NO: 39851 - protein, 126 aa, Neisseria gonorrhoeae
MGRHFGRRRFLTAAAVAVAGAAVSFLPNPFAAGGEKRNMDKKRDENVFFWKGVALGSGAELRLFGVDDRQAADLVNKVLAEVARLEKMFSLYREDSLISRLNRDGYLTSPPADFLELLSLAAIFTR

SEQ ID NO: 39852 - DNA, 378 bp, Neisseria meningitidis
atgggcaggcatttcgggcgcagcgttttctgacggttgccgccgttgcggcggggacgcggcggtttctttcctgccgaatccttttgccgccgatgatgaaaaacgcaacggggatgaaaaacgcaatgaaaatgtgtttttctggaaaggtgtcgcactgggttccggtgcggactccgtctgttcggtgtggacgacaggcgtgcggcggatttggtcaacaaggttttggcggaagtggcgcgtttggaaaaattgttcagcctttaccgtgaagacagcctgatcagccgcctgaacagggacggttatctgacttcgccgtcggcggattttttggaactgktgagcctggccgcgatattcacgckctga

SEQ ID NO: 39853 - protein, 126 aa, Neisseria meningitidis
  misc_feature (7)..(7): Xaa can be any naturally occurring amino acid
  misc_feature (20)..(20): Xaa can be any naturally occurring amino acid
  misc_feature (60)..(60): Xaa can be any naturally occurring amino acid
  misc_feature (118)..(118): Xaa can be any naturally occurring amino acid
  misc_feature (126)..(126): Xaa can be any naturally occurring amino acid
MGRHFGXQRFLTVAAVAAGXAAVSFLPNPFAADDEKRNGDEKRNENVFFWKGVALGSGAXLRLFGVDDRRAADLVNKVLAEVARLEKLFSLYREDSLISRLNRDGYLTSPSADFLELXSLAAIFTX

SEQ ID NO: 39854 - DNA, 381 bp, Neisseria meningitidis
atgggcaggcatttcgggcgcaggcgttttttgacagttgccgccgttgcggcggcgggcgcggcggtttctttcctgccgaatccttttgccgccgatgatgaaaaacgcaataaagatgaaaaacgcaatgaaaatgtgtttttctggaaaggtgtcgcactgggttccggtgcggagctccgtctgttcggtgtggacgacaggcgtgcggcggatttggtcaacaaggttttggcggaagtggcgcgtttggaaaaaatgttcagcctttaccgtgaagacagcctgatcagccgtctgaaccgtgacggttatttgacttcgccgccggcggattttttggaactgttgagcctggccgtgatattcacgcgctga

SEQ ID NO: 39855 - protein, 126 aa, Neisseria meningitidis
MGRHFGRRRFLTVAAVAAAGAAVSFLPNPFAADDEKRNKDEKRNENVFFWKGVALGSGAELRLFGVDDRRAADLVNKVLAEVARLEKMFSLYREDSLISRLNRDGYLTSPPADFLELLSLAVIFTR

SEQ ID NO: 39856 - DNA, 1203 bp, Neisseria gonorrhoeae
  misc_feature (1134)..(1134): n is a, c, g, or t
atgcgccgcttcctaccgatcgcagccatatgcgccgtcgtcctgctgtacggattgacggcggcgaccggcagcaccagttcgctggcggattatttctggtggatagtctcgttcagcgcaatgctgctgctggtgttgtccgccgttttggcacgttatgtcatattgctgttgaaagacaggcgcaacggcgtgttcggttcgcagattgccaaacgcctttccgggatgttcacgctggtcgccgtactgcccggcttgttcctgttcggcatttccgcgcagtttatcaacggcacgattaattcgtggttcggcaacgacacccacgaagccctcgaacgcagccttaatttgagcaagtccgcactggatttggcggcagacaatgccgtcagcaacgccgttcccgtacagatagacctcatcggcaccgcctccctgtcgggcaatatgggcagtgtgctggaacactacgccggcagcggttttgcccagcttgccctgtacaatgccgcaagcgggaaaatcgaaaaaagcatcaatccgcaccaattcgaccagccgcttcccgacaaagaacattgggaacagattcagcagaccggttcggttcggagtttggaaagcataggcggcgtattgtacgcgcagggatggttgtcggcaggtacgcacaacgggcgcgattacgcgctgttcttccgccagccgattcccgaaaatgtggcacaggatgccgttctgattgaaaaggcgcgggcgaaatatgccgaattgagttacagcaaaaaaggtttgcagaccttttttctggtaaccctgctgattgcctcgctgctgtcgatttttcttgcgctggtaatggcactgtattttgcccgccgtttcgtcgaacccattctgtcgcttgccgagggcgcaaaggcggtggcgcagggtgatttcagccagacgcgccccgtattgcgcaacgacgagttcggacgtttgaccaagctgttcaaccatatgaccgagcagctttccatcgccaaagaagcagacgaacgcaaccgccggcgcgaggaagccgcccgtcactacctcgagtgcgtgttggatgggttgactaccggtgtggtggtctcntaccccctctcttgttgccgtaccgcggtgttttccacttgtcattcctcccctctttcttatttctaa

SEQ ID NO: 39857 - protein, 400 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVSYPLSCCRTAVFSTCHSSPLSYF

SEQ ID NO: 39858 - DNA, 1767 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaacsttcaacaaagcggcggaacagattytggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggstggcgtkgaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggacttgccggcgaaccgctga

SEQ ID NO: 39859 - protein, 588 aa, Neisseria meningitidis
  misc_feature (509)..(509): Xaa can be any naturally occurring amino acid
  misc_feature (511)..(511): Xaa can be any naturally occurring amino acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERXAXKLGGKLDEQDAQILTRSTDTIVKQVAALKEMVEAFRNYARSPSLKLENQDLNALIGDVLALYEAGPCRFAADLPANR
